(12) United States Patent
Turner et al.

(10) Patent No.: US 6,433,142 B1
(45) Date of Patent: Aug. 13, 2002

(54) MEGAKARYOCYTE STIMULATING FACTORS

(75) Inventors: Katherine Turner, Melrose; Steven C. Clark, Winchester; Kenneth Jacobs, Newton; Rodney M. Hewick, Lexington, all of MA (US); Thomas G. Gesner, Richmond, CA (US)

(73) Assignee: Genetics Institute, LLC, Cambridge, MA (US)

( * ) Notice: Subject to any disclaimer, the term of this patent is extended or adjusted under 35 U.S.C. 154(b) by 0 days.

(21) Appl. No.: 07/757,022

(22) Filed: Sep. 10, 1991

Related U.S. Application Data

(63) Continuation-in-part of application No. 07/643,502, filed on Jan. 18, 1991, now abandoned, which is a continuation-in-part of application No. 07/546,114, filed on Jun. 29, 1990, now Pat. No. 5,326,558, which is a continuation-in-part of application No. 07/457,196, filed on Dec. 28, 1989, now abandoned, which is a continuation-in-part of application No. 07/390,901, filed on Aug. 8, 1989, now abandoned.

(51) Int. Cl.$^7$ .............................................. C07K 14/52
(52) U.S. Cl. ........................................... 530/351; 514/2
(58) Field of Search ................................. 530/351, 380, 530/350; 430/145; 435/69.5, 69.6; 514/2

(56) References Cited

U.S. PATENT DOCUMENTS

| 4,658,018 A | 4/1987 | Urdal et al. ................. 530/351 |
| 4,894,440 A | 1/1990 | Rosenberg .................. 530/351 |

FOREIGN PATENT DOCUMENTS

| AU | 598297 B2 | 6/1990 |
| EP | 354989 | 2/1990 |
| JP | WO 91/18925 | 1/1992 |
| WO | WO9003397 | 4/1990 |
| WO | WO 92/00319 | 12/1991 |

OTHER PUBLICATIONS

R. Hoffman et al., J. Clin. Invest., 75:1174–1182 (1985).
H.H. Yang et al., Chem Abstr., 105(5): 36292x (1986).
M. Kawakita et al., Chem Abstr. 105(13): 109495y (1986).
M. Kawakita et al., Prog. Clin. Biol. Res., 215: 201–208 (1986).
T. Miyake et al., Chem Abstr., 98 (11): 83667v (1982).
P. Hunt et al., Blood, 76(10: 460a, abstract #1830 (Nov. 1990).

*Primary Examiner*—John Ulm
(74) *Attorney, Agent, or Firm*—Barbara Gyure Wyeth

(57) ABSTRACT

Novel human megakaryocyte stimulating factors (MSFS) capable of stimulating the growth and development of colonies of megakaryocytes, pharmaceutical compositions containing same, and methods for their preparation and use are provided.

3 Claims, 11 Drawing Sheets

```
                                    Exon I
ATG GCA TGG AAA ACA CTT CCC ATT TAC CTG TTG TTG CTG CTG TCT GTT        48
Met Ala Trp Lys Thr Leu Pro Ile Tyr Leu Leu Leu Leu Leu Ser Val
 1            5                  10                  15

----------Exon II----------
TTC GTG ATT CAG CAA GTT TCA TCT CAA GAT TTA TCA AGC TGT GCA GGG        96
Phe Val Ile Gln Gln Val Ser Ser Gln Asp Leu Ser Ser Cys Ala Gly
            20                  25                  30

AGA TGT GGG GAA GGG TAT TCT AGA GAT GCC ACC TGC AAC TGT GAT TAT       144
Arg Cys Gly Glu Gly Tyr Ser Arg Asp Ala Thr Cys Asn Cys Asp Tyr
            35                  40                  45

AAC TGT CAA CAC TAC ATG GAG TGC TGC CCT GAT TTC AAG AGA GTC TGC       192
Asn Cys Gln His Tyr Met Glu Cys Cys Pro Asp Phe Lys Arg Val Cys
        50                  55                  60

Exon III
ACT GCG GAG CTT TCC TGT AAA GGC CGC TGC TTT GAG TCC TTC GAG AGA       240
Thr Ala Glu Leu Ser Cys Lys Gly Arg Cys Phe Glu Ser Phe Glu Arg
 65                  70                  75                  80

GGG AGG GAG TGT GAC TGC GAC GCC CAA TGT AAG AAG TAT GAC AAG TGC       288
Gly Arg Glu Cys Asp Cys Asp Ala Gln Cys Lys Lys Tyr Asp Lys Cys
                    85                  90                  95

------Exon IV---------
TGT CCC GAT TAT GAG AGT TTC TGT GCA GAA GTG CAT AAT CCC ACA TCA       336
Cys Pro Asp Tyr Glu Ser Phe Cys Ala Glu Val His Asn Pro Thr Ser
                100                 105                 110

CCA CCA TCT TCA AAG AAA GCA CCT CCA CCT TCA GGA GCA TCT CAA ACC       384
Pro Pro Ser Ser Lys Lys Ala Pro Pro Pro Ser Gly Ala Ser Gln Thr
            115                 120                 125

ATC AAA TCA ACA ACC AAA CGT TCA CCC AAA CCA CCA AAC AAG AAG AAG       432
Ile Lys Ser Thr Thr Lys Arg Ser Pro Lys Pro Pro Asn Lys Lys Lys
        130                 135                 140

ACT AAG AAA GTT ATA GAA TCA GAG GAA ATA ACA GAA GAA CAT TCT GTT       480
Thr Lys Lys Val Ile Glu Ser Glu Glu Ile Thr Glu Glu His Ser Val
145                 150                 155                 160
    Exon V
TCT GAA AAT CAA GAG TCC TCC TCC TCC TCC TCC TCT TCC TCT TCT TCT       528
Ser Glu Asn Gln Glu Ser Ser Ser Ser Ser Ser Ser Ser Ser Ser Ser
                    165                 170                 175

TCA ACA ATT TGG AAA ATC AAG TCT TCC AAA AAT TCA GCT GCT AAT AGA       576
Ser Thr Ile Trp Lys Ile Lys Ser Ser Lys Asn Ser Ala Ala Asn Arg
            180                 185                 190
```

*FIG. 1A*

```
                                              -------Exon VI----------------
GAA TTA CAG AAG AAA CTC AAA GTA AAA GAT AAC AAG AAG AAC AGA ACT        624
Glu Leu Gln Lys Lys Leu Lys Val Lys Asp Asn Lys Lys Asn Arg Thr
        195             200                 205

AAA AAG AAA CCT ACC CCC AAA CCA CCA GTT GTA GAT GAA GCT GGA AGT        672
Lys Lys Lys Pro Thr Pro Lys Pro Pro Val Val Asp Glu Ala Gly Ser
        210             215                 220

GGA TTG GAC AAT GGT GAC TTC AAG GTC ACA ACT CCT GAC ACG TCT ACC        720
Gly Leu Asp Asn Gly Asp Phe Lys Val Thr Thr Pro Asp Thr Ser Thr
225             230             235                 240

ACC CAA CAC AAT AAA GTC AGC ACA TCT CCC AAG ATC ACA ACA GCA AAA        768
Thr Gln His Asn Lys Val Ser Thr Ser Pro Lys Ile Thr Thr Ala Lys
                245             250                 255

CCA ATA AAT CCC AGA CCC AGT CTT CCA CCT AAT TCT GAT ACA TCT AAA        816
Pro Ile Asn Pro Arg Pro Ser Leu Pro Pro Asn Ser Asp Thr Ser Lys
        260             265                 270

GAG ACG TCT TTG ACA GTG AAT AAA GAG ACA ACA GTT GAA ACT AAA GAA        864
Glu Thr Ser Leu Thr Val Asn Lys Glu Thr Thr Val Glu Thr Lys Glu
        275             280                 285

ACT ACT ACA ACA AAT AAA CAG ACT TCA ACT GAT GGA AAA GAG AAG ACT        912
Thr Thr Thr Thr Asn Lys Gln Thr Ser Thr Asp Gly Lys Glu Lys Thr
        290             295                 300

ACT TCC GCT AAA GAG ACA CAA AGT ATA GAG AAA ACA TCT GCT AAA GAT        960
Thr Ser Ala Lys Glu Thr Gln Ser Ile Glu Lys Thr Ser Ala Lys Asp
305             310             315                 320

TTA GCA CCC ACA TCT AAA GTG CTG GCT AAA CCT ACA CCC AAA GCT GAA       1008
Leu Ala Pro Thr Ser Lys Val Leu Ala Lys Pro Thr Pro Lys Ala Glu
        325             330                 335

ACT ACA ACC AAA GGC CCT GCT CTC ACC ACT CCC AAG GAG CCC ACG CCC       1056
Thr Thr Thr Lys Gly Pro Ala Leu Thr Thr Pro Lys Glu Pro Thr Pro
        340             345                 350

ACC ACT CCC AAG GAG CCT GCA TCT ACC ACA CCC AAA GAG CCC ACA CCT       1104
Thr Thr Pro Lys Glu Pro Ala Ser Thr Thr Pro Lys Glu Pro Thr Pro
        355             360                 365

ACC ACC ATC AAG TCT GCA CCC ACC ACC CCC AAG GAG CCT GCA CCC ACC       1152
Thr Thr Ile Lys Ser Ala Pro Thr Thr Pro Lys Glu Pro Ala Pro Thr
        370             375                 380

ACC ACC AAG TCT GCA CCC ACT CCC AAG GAG CCT GCA CCC ACC ACC           1200
Thr Thr Lys Ser Ala Pro Thr Pro Lys Glu Pro Ala Pro Thr Thr
385             390             395                 400
```

*FIG. 1B*

```
ACC AAG GAG CCT GCA CCC ACC ACT CCC AAG GAG CCT GCA CCC ACC ACC      1248
Thr Lys Glu Pro Ala Pro Thr Thr Pro Lys Glu Pro Ala Pro Thr Thr
            405             410             415

ACC AAG GAG CCT GCA CCC ACC ACC ACC AAG TCT GCA CCC ACC ACT CCC      1296
Thr Lys Glu Pro Ala Pro Thr Thr Thr Lys Ser Ala Pro Thr Thr Pro
            420             425             430

AAG GAG CCT GCA CCC ACC ACC CCC AAG AAG CCT GCC CCA ACT ACC CCC      1344
Lys Glu Pro Ala Pro Thr Thr Pro Lys Lys Pro Ala Pro Thr Thr Pro
        435             440             445

AAG GAG CCT GCA CCC ACC ACT CCC AAG GAG CCT ACA CCC ACC ACT CCC      1392
Lys Glu Pro Ala Pro Thr Thr Pro Lys Glu Pro Thr Pro Thr Thr Pro
        450             455             460

AAG GAG CCT GCA CCC ACC ACC AAG GAG CCT GCA CCC ACC ACT CCC AAA      1440
Lys Glu Pro Ala Pro Thr Thr Lys Glu Pro Ala Pro Thr Thr Pro Lys
465             470             475             480

GAG CCT GCA CCC ACT GCC CCC AAG AAG CCT GCC CCA ACT ACC CCC AAG      1488
Glu Pro Ala Pro Thr Ala Pro Lys Lys Pro Ala Pro Thr Thr Pro Lys
            485             490             495

GAG CCT GCA CCC ACC ACT CCC AAG GAG CCT GCA CCC ACC ACC ACC AAG      1536
Glu Pro Ala Pro Thr Thr Pro Lys Glu Pro Ala Pro Thr Thr Thr Lys
            500             505             510

GAG CCT TCA CCC ACC ACT CCC AAG GAG CCT GCA CCC ACC ACC ACC AAG      1584
Glu Pro Ser Pro Thr Thr Pro Lys Glu Pro Ala Pro Thr Thr Thr Lys
            515             520             525

TCT GCA CCC ACC ACT ACC AAG GAG CCT GCA CCC ACC ACT ACC AAG TCT      1632
Ser Ala Pro Thr Thr Thr Lys Glu Pro Ala Pro Thr Thr Thr Lys Ser
        530             535             540

GCA CCC ACC ACT CCC AAG GAG CCT TCA CCC ACC ACC ACC AAG GAG CCT      1680
Ala Pro Thr Thr Pro Lys Glu Pro Ser Pro Thr Thr Thr Lys Glu Pro
545             550             555             560

GCA CCC ACC ACT CCC AAG GAG CCT GCA CCC ACC ACC CCC AAG AAG CCT      1728
Ala Pro Thr Thr Pro Lys Glu Pro Ala Pro Thr Thr Pro Lys Lys Pro
            565             570             575

GCC CCA ACT ACC CCC AAG GAG CCT GCA CCC ACC ACT CCC AAG GAA CCT      1776
Ala Pro Thr Thr Pro Lys Glu Pro Ala Pro Thr Thr Pro Lys Glu Pro
            580             585             590

GCA CCC ACC ACC ACC AAG AAG CCT GCA CCC ACC GCT CCC AAA GAG CCT      1824
Ala Pro Thr Thr Thr Lys Lys Pro Ala Pro Thr Ala Pro Lys Glu Pro
        595             600             605
```

*FIG. 1C*

```
GCC CCA ACT ACC CCC AAG GAG ACT GCA CCC ACC ACC CCC AAG AAG CTC        1872
Ala Pro Thr Thr Pro Lys Glu Thr Ala Pro Thr Thr Pro Lys Lys Leu
    610             615             620

ACG CCC ACC ACC CCC GAG AAG CTC GCA CCC ACC ACC CCT GAG AAG CCC        1920
Thr Pro Thr Thr Pro Glu Lys Leu Ala Pro Thr Thr Pro Glu Lys Pro
625             630             635             640

GCA CCC ACC ACC CCT GAG GAG CTC GCA CCC ACC ACC CCT GAG GAG CCC        1968
Ala Pro Thr Thr Pro Glu Glu Leu Ala Pro Thr Thr Pro Glu Glu Pro
            645             650             655

ACA CCC ACC ACC CCT GAG GAG CCT GCT CCC ACC ACT CCC AAG GCA GCG        2016
Thr Pro Thr Thr Pro Glu Glu Pro Ala Pro Thr Thr Pro Lys Ala Ala
            660             665             670

GCT CCC AAC ACC CCT AAG GAG CCT GCT CCA ACT ACC CCT AAG GAG CCT        2064
Ala Pro Asn Thr Pro Lys Glu Pro Ala Pro Thr Thr Pro Lys Glu Pro
        675             680             685

GCT CCA ACT ACC CCT AAG GAG CCT GCT CCA ACT ACC CCT AAG GAG ACT        2112
Ala Pro Thr Thr Pro Lys Glu Pro Ala Pro Thr Thr Pro Lys Glu Thr
    690             695             700

GCT CCA ACT ACC CCT AAA GGG ACT GCT CCA ACT ACC CTC AAG GAA CCT        2160
Ala Pro Thr Thr Pro Lys Gly Thr Ala Pro Thr Thr Leu Lys Glu Pro
705             710             715             720

GCA CCC ACT ACT CCC AAG AAG CCT GCC CCC AAG GAG CTT GCA CCC ACC        2208
Ala Pro Thr Thr Pro Lys Lys Pro Ala Pro Lys Glu Leu Ala Pro Thr
            725             730             735

ACC ACC AAG GAG CCC ACA TCC ACC ACC TCT GAC AAG CCC GCT CCA ACT        2256
Thr Thr Lys Glu Pro Thr Ser Thr Thr Ser Asp Lys Pro Ala Pro Thr
        740             745             750

ACC CCT AAG GGG ACT GCT CCA ACT ACC CCT AAG GAG CCT GCT CCA ACT        2304
Thr Pro Lys Gly Thr Ala Pro Thr Thr Pro Lys Glu Pro Ala Pro Thr
        755             760             765

ACC CCT AAG GAG CCT GCT CCA ACT ACC CCT AAG GGG ACT GCT CCA ACT        2352
Thr Pro Lys Glu Pro Ala Pro Thr Thr Pro Lys Gly Thr Ala Pro Thr
    770             775             780

ACC CTC AAG GAA CCT GCA CCC ACT ACT CCC AAG AAG CCT GCC CCC AAG        2400
Thr Leu Lys Glu Pro Ala Pro Thr Thr Pro Lys Lys Pro Ala Pro Lys
785             790             795             800

GAG CTT GCA CCC ACC ACC ACC AAG GGG CCC ACA TCC ACC ACC TCT GAC        2448
Glu Leu Ala Pro Thr Thr Thr Lys Gly Pro Thr Ser Thr Thr Ser Asp
            805             810             815
```

FIG. 1D

```
AAG CCT GCT CCA ACT ACA CCT AAG GAG ACT GCT CCA ACT ACC CCC AAG           2496
Lys Pro Ala Pro Thr Thr Pro Lys Glu Thr Ala Pro Thr Thr Pro Lys
            820             825             830

GAG CCT GCA CCC ACT ACC CCC AAG AAG CCT GCT CCA ACT ACT CCT GAG           2544
Glu Pro Ala Pro Thr Thr Pro Lys Lys Pro Ala Pro Thr Thr Pro Glu
            835             840             845

ACA CCT CCT CCA ACC ACT TCA GAG GTC TCT ACT CCA ACT ACC ACC AAG           2592
Thr Pro Pro Pro Thr Thr Ser Glu Val Ser Thr Pro Thr Thr Thr Lys
850             855             860

GAG CCT ACC ACT ATC CAC AAA AGC CCT GAT GAA TCA ACT CCT GAG CTT           2640
Glu Pro Thr Thr Ile His Lys Ser Pro Asp Glu Ser Thr Pro Glu Leu
865             870             875             880

TCT GCA GAA CCC ACA CCA AAA GCT CTT GAA AAC AGT CCC AAG GAA CCT           2688
Ser Ala Glu Pro Thr Pro Lys Ala Leu Glu Asn Ser Pro Lys Glu Pro
            885             890             895

GGT GTA CCT ACA ACT AAG ACT CCT GCA GCG ACT AAA CCT GAA ATG ACT           2736
Gly Val Pro Thr Thr Lys Thr Pro Ala Ala Thr Lys Pro Glu Met Thr
            900             905             910

ACA ACA GCT AAA GAC AAG ACA ACA GAA AGA GAC TTA CGT ACT ACA CCT           2784
Thr Thr Ala Lys Asp Lys Thr Thr Glu Arg Asp Leu Arg Thr Thr Pro
            915             920             925

GAA ACT ACA ACT GCT GCA CCT AAG ATG ACA AAA GAG ACA GCA ACT ACA           2832
Glu Thr Thr Thr Ala Ala Pro Lys Met Thr Lys Glu Thr Ala Thr Thr
            930             935             940

ACA GAA AAA ACT ACC GAA TCC AAA ATA ACA GCT ACA ACC ACA CAA GTA           2880
Thr Glu Lys Thr Thr Glu Ser Lys Ile Thr Ala Thr Thr Thr Gln Val
945             950             955             960

ACA TCT ACC ACA ACT CAA GAT ACC ACA CCA TTC AAA ATT ACT ACT CTT           2928
Thr Ser Thr Thr Thr Gln Asp Thr Thr Pro Phe Lys Ile Thr Thr Leu
            965             970             975

AAA ACA ACT ACT CTT GCA CCC AAA GTA ACT ACA ACA AAG AAG ACA ATT           2976
Lys Thr Thr Thr Leu Ala Pro Lys Val Thr Thr Thr Lys Lys Thr Ile
            980             985             990

ACT ACC ACT GAG ATT ATG AAC AAA CCT GAA GAA ACA GCT AAA CCA AAA           3024
Thr Thr Thr Glu Ile Met Asn Lys Pro Glu Glu Thr Ala Lys Pro Lys
            995             1000            1005

GAC AGA GCT ACT AAT TCT AAA GCG ACA ACT CCT AAA CCT CAA AAG CCA           3072
Asp Arg Ala Thr Asn Ser Lys Ala Thr Thr Pro Lys Pro Gln Lys Pro
            1010            1015            1020
```

FIG. 1E

```
ACC AAA GCA CCC AAA AAA CCC ACT TCT ACC AAA AAG CCA AAA ACA ATG        3120
Thr Lys Ala Pro Lys Lys Pro Thr Ser Thr Lys Lys Pro Lys Thr Met
1025             1030            1035            1040

CCT AGA GTG AGA AAA CCA AAG ACG ACA CCA ACT CCC CGC AAG ATG ACA        3168
Pro Arg Val Arg Lys Pro Lys Thr Thr Pro Thr Pro Arg Lys Met Thr
            1045            1050            1055

TCA ACA ATG CCA GAA TTG AAC CCT ACC TCA AGA ATA GCA GAA GCC ATG        3216
Ser Thr Met Pro Glu Leu Asn Pro Thr Ser Arg Ile Ala Glu Ala Met
        1060            1065            1070

CTC CAA ACC ACC ACC AGA CCT AAC CAA ACT CCA AAC TCC AAA CTA GTT        3264
Leu Gln Thr Thr Thr Arg Pro Asn Gln Thr Pro Asn Ser Lys Leu Val
        1075            1080            1085

GAA GTA AAT CCA AAG AGT GAA GAT GCA GGT GGT GCT GAA GGA GAA ACA        3312
Glu Val Asn Pro Lys Ser Glu Asp Ala Gly Gly Ala Glu Gly Glu Thr
        1090            1095            1100

CCT CAT ATG CTT CTC AGG CCC CAT GTG TTC ATG CCT GAA GTT ACT CCC        3360
Pro His Met Leu Leu Arg Pro His Val Phe Met Pro Glu Val Thr Pro
1105            1110            1115            1120

GAC ATG GAT TAC TTA CCG AGA GTA CCC AAT CAA GGC ATT ATC ATC AAT        3408
Asp Met Asp Tyr Leu Pro Arg Val Pro Asn Gln Gly Ile Ile Ile Asn
                1125            1130            1135
                                  Exon VII
CCC ATG CTT TCC GAT GAG ACC AAT ATA TGC AAT GGT AAG CCA GTA GAT        3456
Pro Met Leu Ser Asp Glu Thr Asn Ile Cys Asn Gly Lys Pro Val Asp
            1140            1145            1150

GGA CTG ACT ACT TTG CGC AAT GGG ACA TTA GTT GCA TTC CGA GGT CAT        3504
Gly Leu Thr Thr Leu Arg Asn Gly Thr Leu Val Ala Phe Arg Gly His
        1155            1160            1165
-----------Exon VIII-----------
TAT TTC TGG ATG CTA AGT CCA TTC AGT CCA CCA TCT CCA GCT CGC AGA        3552
Tyr Phe Trp Met Leu Ser Pro Phe Ser Pro Pro Ser Pro Ala Arg Arg
        1170            1175            1180

ATT ACT GAA GTT TGG GGT ATT CCT TCC CCC ATT GAT ACT GTT TTT ACT        3600
Ile Thr Glu Val Trp Gly Ile Pro Ser Pro Ile Asp Thr Val Phe Thr
1185            1190            1195            1200
                                              Exon IX
AGG TGC AAC TGT GAA GGA AAA ACT TTC TTC TTT AAG GAT TCT CAG TAC        3648
Arg Cys Asn Cys Glu Gly Lys Thr Phe Phe Phe Lys Asp Ser Gln Tyr
                1205            1210            1215

TGG CGT TTT ACC AAT GAT ATA AAA GAT GCA GGG TAC CCC AAA CCA ATT        3696
Trp Arg Phe Thr Asn Asp Ile Lys Asp Ala Gly Tyr Pro Lys Pro Ile
            1220            1225            1230
```

FIG. 1F

```
TTC AAA GGA TTT GGA GGA CTA ACT GGA CAA ATA GTG GCA GCG CTT TCA      3744
Phe Lys Gly Phe Gly Gly Leu Thr Gly Gln Ile Val Ala Ala Leu Ser
        1235            1240            1245

ACA GCT AAA TAT AAG AAC TGG CCT GAA TCT GTG TAT TTT TTC AAG AGA      3792
Thr Ala Lys Tyr Lys Asn Trp Pro Glu Ser Val Tyr Phe Phe Lys Arg
        1250            1255            1260

------------------Exon X-----------------------------------------
GGT GGC AGC ATT CAG CAG TAT ATT TAT AAA CAG GAA CCT GTA CAG AAG      3840
Gly Gly Ser Ile Gln Gln Tyr Ile Tyr Lys Gln Glu Pro Val Gln Lys
1265            1270            1275            1280

TGC CCT GGA AGA AGG CCT GCT CTA AAT TAT CCA GTG TAT GGA GAA ATG      3888
Cys Pro Gly Arg Arg Pro Ala Leu Asn Tyr Pro Val Tyr Gly Glu Met
            1285            1290            1295

ACA CAG GTT AGG AGA CGT CGC TTT GAA CGT GCT ATA GGA CCT TCT CAA      3936
Thr Gln Val Arg Arg Arg Arg Phe Glu Arg Ala Ile Gly Pro Ser Gln
            1300            1305            1310

ACA CAC ACC ATC AGA ATT CAA TAT TCA CCT GCC AGA CTG GCT TAT CAA      3984
Thr His Thr Ile Arg Ile Gln Tyr Ser Pro Ala Arg Leu Ala Tyr Gln
        1315            1320            1325

----------          Exon XI
GAC AAA GGT GTC CTT CAT AAT GAA GTT AAA GTG AGT ATA CTG TGG AGA      4032
Asp Lys Gly Val Leu His Asn Glu Val Lys Val Ser Ile Leu Trp Arg
        1330            1335            1340

GGA CTT CCA AAT GTG GTT ACC TCA GCT ATA TCA CTG CCC AAC ATC AGA      4080
Gly Leu Pro Asn Val Val Thr Ser Ala Ile Ser Leu Pro Asn Ile Arg
1345            1350            1355            1360

AAA CCT GAC GGC TAT GAT TAC TAT GCC TTT TCT AAA GAT CAA TAC TAT      4128
Lys Pro Asp Gly Tyr Asp Tyr Tyr Ala Phe Ser Lys Asp Gln Tyr Tyr
            1365            1370            1375

-----Exon XII----------------------------------------------------
AAC ATT GAT GTG CCT AGT AGA ACA GCA AGA GCA ATT ACT ACT CGT TCT      4176
Asn Ile Asp Val Pro Ser Arg Thr Ala Arg Ala Ile Thr Thr Arg Ser
            1380            1385            1390

GGG CAG ACC TTA TCC AAA GTC TGG TAC AAC TGT CCT TAG ACTGATGAGC       4225
Gly Gln Thr Leu Ser Lys Val Trp Tyr Asn Cys Pro  *
            1395            1400            1405

AAAGGAGGAG TCAACTAATG AAGAAATGAA TAATAAATTT TGACACTGAA               4275

AAACATTTTA TTAATAAAGA ATATTGACAT GAGTATACCA GTTTATATAT               4325

AAAAATGTTT TTAAACTTGA CAATCATTAC ACTAAAACAG ATTTGATAAT               4375

CTTATTCACA GTTGTTATTG TTTACAGACC ATTTAATTAA TATTTCCTCT               4425
```

*FIG. 1G*

```
GTTTATTCCT CCTCTCCCTC CCATTGCATG GCTCACACCT GTAAAAGAAA        4475
AAAGAATCAA ATTGAATATA TCTTTTAAGA ATTCAAAACT AGTGTATTCA        4525
CTTACCCTAG TTCATTATAA AAAATATCTA GGCATTGTGG ATATAAAACT        4575
GTTGGGTATT CTACAACTTC AATGGAAATT ATTACAAGCA GATTAATCCC        4625
TCTTTTTGTG ACACAAGTAC AATCTAAAAG TTATATTGGA AAACATGGAA        4675
ATATTAAAAT TTTACACTTT TACTAGCTAA AACATAATCA CAAAGCTTTA        4725
TCGTGTTGTA TAAAAAAATT AACAATATAA TGGCAATAGG TAGAGATACA        4775
ACAAATGAAT ATAACACTAT AACACTTCAT ATTTTCCAAA TCTTAATTTG        4825
GATTTAAGGA AGAAATCAAT AAATATAAAA TATAAGCACA TATTTATTAT        4875
ATATCTAAGG TATACAAATC TGTCTACATG AAGTTTACAG ATTGGTAAAT        4925
ATCACCTGCT CAACATGTAA TTATTTAATA AAACTTTGGA ACATTAAAAA        4975
AATAAATTGG AGGCTTAAAA AAAAAAAAAA AAA                          5008
```

*FIG. 1H*

Enterokinase site | Exon II
GAT GAC GAT GAC AAG AAC GGT TTA TCT TCT TGT GCA GGT
Asp Asp Asp Asp Lys Asn Gly Leu Ser Ser Cys Ala Gly
1                   5                        10

CGT TGT GGT GAA GGT TAT TCT AGA GAT GCC ACC TGC AAC TGT GAT TAT
Arg Cys Gly Glu Gly Tyr Ser Arg Asp Ala Thr Cys Asn Cys Asp Tyr
          15                      20                      25

AAC TGT CAA CAC TAC ATG GAG TGC TGC CCT GAT TTC AAG AGA GTC TGC
Asn Cys Gln His Tyr Met Glu Cys Cys Pro Asp Phe Lys Arg Val Cys
30                      35                      40              45
                                                        Exon III
ACT GCG GAG CTT TCC TGT AAA GGC CGC TGC TTT GAG TCC TTC GAG AGA
Thr Ala Glu Leu Ser Cys Lys Gly Arg Cys Phe Glu Ser Phe Glu Arg
          50                      55                      60

GGG AGG GAG TGT GAC TGC GAC GCC CAA TGT CAA GAA TAT GAC AAG TGC
Gly Arg Glu Cys Asp Cys Asp Ala Gln Cys Gln Glu Tyr Asp Lys Cys
          65                      70                      75
                                                         Exon IV
TGT CCC GAT TAT GAG AGT TTC TGT GCA GAA GTG CAT AAT CCC ACA TCA
Cys Pro Asp Tyr Glu Ser Phe Cys Ala Glu Val His Asn Pro Thr Ser
          80                      85                      90

FIG. 3A

```
CCA CCA TCT TCA AAG AAA GCA CCT CCA CCT TCA GGA GCA TCT CAA ACC
Pro Pro Ser Ser Lys Lys Ala Pro Pro Pro Ser Gly Ala Ser Gln Thr
         95                      100                     105

ATC AAA TAA CAACCAAACG TTCACCCAAA CCACCAAACA AGAAGAAGAC TAAGAAAGTT
Ile Lys

ATAGAATCAG AGGAAATAAC AGAAGAAACAT TCTGTTTCTG AAAATCAAGA GTCCTCCTCC

TCCTCCTCCT CTTCCTCTTC TTCTTCAACA ATTTGGAAAA TCAAGTCTTC CAAAAATTCA

GCTGCTAATA GAGAATTACA GAAGAAACTC AAAGTAAAAG ATAACAAGAA GAACAGAACT

XhoI
AAAAAGAAAC CTACCCCCAA ACCACCAGTT GTAGATTAGC TCGAG
```

*FIG. 3B*

MEGAKARYOCYTE STIMULATING FACTORS

This application is a continuation-in-part of U.S. patent application Ser. No. 07/643,502, filed Jan. 18, 1991 now abandoned, which is a continuation-in-part of U.S. patent application Ser. No. 07/546,114, filed Jun. 29, 1990, now U.S. Pat. No. 5,326,558, which is a continuation-in-part of U.S. patent application Ser. No. 07/457,196 filed Dec. 28, 1989 now abandoned, which is a continuation-in-part of U.S. patent application Ser. No. 07/390,901 filed Aug. 8, 1989 now abandoned.

The present invention relates generally to a family of novel protein factors which share homologous sequences and biological activities with megakaryocyte colony-stimulating factor (meg-CSF) and which participate in the differentiation or maturation of megakaryocyte progenitors. Also provided are processes for obtaining and producing the factors from natural sources or by artificial means, e.g., chemical synthesis or recombinant genetic engineering techniques.

BACKGROUND OF THE INVENTION

Megakaryocytes are the hematopoietic cells, largely found in the bone marrow, but also in peripheral blood and perhaps other tissues as well, which produce platelets (also known as thrombocytes) and subsequently release them into circulation. Megakaryocytes, like all of the hematopoietic cells of the human hematopoietic system, ultimately are derived from a primitive stem cell after passing through a complex pathway comprising many cellular divisions and considerable differentiation and maturation.

The platelets derived from these megakaryocytic cells are critical for maintaining hemostasis and for initiating blood clot formation at sites of injury. Platelets also release growth factors at the site of clot formation that speed the process of wound healing and may serve other functions. However, in patients suffering from depressed levels of platelets (thrombocytopenia) the inability to form clots is the most immediate and serious consequence, a potentially fatal complication of many therapies for cancer. Such cancer patients are generally treated for this problem with platelet transfusions. Other patients frequently requiring platelet transfusions are those undergoing bone marrow transplantation or patients with aplastic anemia.

Platelets for such procedures are obtained by platelet-phoresis from normal donors. Like most human blood products, platelets for transfusion have a relatively short shelf-life and also expose the patients to considerable risk of exposure to dangerous viruses, such as the human immunodeficiency virus (HIV) or a hepatitis virus.

Clearly the ability to stimulate endogenous platelet formation in thrombocytopenic patients with a concomitant reduction in their dependence on platelet transfusion would be of great benefit. In addition, the ability to correct or prevent thrombocytopenia in patients undergoing radiation therapy or chemotherapy for cancer would make such treatments safer and possibly permit increases in the intensity of the therapy thereby yielding greater anti-cancer effects.

For these reasons considerable research has been devoted to the identification and purification of factors involved in the regulation of megakaryocyte and platelet production. Although there is considerable controversy on this subject, the factors regulating the growth and differentiation of hematopoietic cells into mature megakaryocytes and the subsequent production of platelets by these cells are believed to fall into two classes: (1) megakaryocyte colony-stimulating factors (meg-CSFs) which support the proliferation and differentiation of megakaryocytic progenitors in culture, and (2) thrombopoietic (TPO) factors which support the differentiation and maturation of megakaryocytes in vivo, resulting in the production and release of platelets. [See, e.g., E. Mazur, *Exp. Hematol.*, 15:340–350 (1987).]

Each class of factors can be defined by bioassay. Factors with meg-CSF activity support megakaryocyte colony formation, while factors with TPO activity elicit an elevation in the numbers of circulating platelets when administered to animals. It is not clear how many species of factors exist that have either one or both of these activities. For example, human IL-3 supports human megakaryocyte colony formation and, at least in monkeys, frequently elicits an elevation in platelet count. However, IL-3 influences hematopoietic cell development in all of the hematopoietic lineages and can be distinguished from specific regulators of megakaryocytopoiesis and platelet formation which interact selectively with cells of the megakaryocytic lineage.

Many different reports in the literature describe factors which interact with cells of the megakaryocytic lineage. Several putative meg-CSF compositions have been derived from serum [See, e.g., R. Hoffman et al, *J. Clin. Invest.*, 75:1174–1182 (1985); J. E. Straneva et al, *Exp. Hematol.*, 15:657–663 (1987); E. Mazur et al, *Exp. Hematol.*, 13:1164–1172 (1985]. A large number of reports of a TPO factor are in the art. [See, e.g., T. P. McDonald, *Exp. Hematol.*, 16:201–205 (1988); T. P. McDonald et al, *Biochem. Med. Metab. Biol.*, 37:335–343 (1987); T. Tayrien et al, *J. Biol. Chem.*, 262: 3262–3268 (1987) and others]. From the studies reported to date, it is not clear whether factors having activities identified as meg-CSF also have TPO activity or vice versa.

Although there have been numerous additional reports tentatively identifying these regulatory factors, the biochemical and biological identification and characterization of meg-CSF and TPO factors have been hampered by the small quantities of the naturally occurring factors which are present in natural sources, e.g., blood and urine.

The present inventors have previously identified a purified meg-CSF factor from urine described in PCT application No. WO91/02001, published Feb. 21, 1991, and further described in pending U.S. patent application Ser. No. 07/643,502 now abandoned. This homogeneous meg-CSF, purified from urine and which may be produced via recombinant or synthetic techniques, is characterized by a specific activity in the murine fibrin clot assay of greater than $5 \times 10^7$ dilution units per mg and preferably, $2 \times 10^8$ dilution units per mg protein. This meg-CSF was processed from a precursor protein encoded by an approximately 18.2 kb genomic clone which contains ten exons. Two additional exons were subsequently identified outside this 18.2 kb segment. cDNAs made from the full length cDNA and from partial cDNAs have been expressed in COS-1 cells and CHO cells. These references are incorporated herein by reference for the disclosure of that meg-CSF molecule.

There remains a need in the art for additional proteins either isolated from association with other proteins or substances from their natural sources or otherwise produced in homogeneous form, which are capable of stimulating or enhancing the production of platelets in vivo, to replace presently employed platelet transfusions and to stimulate the production of other cells of the lymphohematopoietic system.

BRIEF SUMMARY OF THE INVENTION

In one aspect the present invention provides a family of human megakaryocyte stimulating factors (hereafter called MSFs) or biologically active peptide fragments thereof that are substantially free from association with proteins or substances with which they occur in nature. The MSF family includes non-naturally occurring MSF proteins which are characterized by sharing similar structure, DNA and amino acid sequences, and!or biological activity with naturally-occurring MSFS. Naturally-occurring MSFs may be isolated and purified from natural sources. Non-naturally occurring MSFs may be prepared by chemical synthesis and/or recombinant genetic engineering techniques.

These MSF proteins comprise DNA sequences encoding one or more of the exon sequences described below in FIG. 1 or biologically active fragments thereof. Each MSF protein of this invention is also characterized by one or a combination of the physical, biochemical, pharmacological or biological activities described herein.

Another aspect of the present invention includes a mixture of different MSFs, and active fragments thereof.

Another aspect of the present invention includes DNA sequences that encode the expression of these naturally occurring and non-naturally occurring MSFs.

Still another aspect of the present invention are recombinant DNA molecules comprising vector DNAs and DNA sequences encoding the MSFs of this invention. Each DNA molecule provides the MSF DNA in operative association with a regulatory sequence capable of directing the replication and expression of each MSF in a selected host cell. Host cells transformed with such DNA molecules for use in expressing recombinant MSF proteins are also provided by the present invention.

The DNA molecules and transformed cells of the invention may be employed in a novel process for producing recombinant MSFs, or biologically active peptide fragments thereof. A cell line, transformed with a DNA sequence encoding expression of individual MSFs or fragments thereof (or a recombinant DNA molecule as described above) in operative association with a suitable regulatory or expression control sequence capable of controlling expression of the protein, is cultured under appropriate conditions permitting expression of the recombinant DNA. The expressed MSF protein is then harvested from the host cell, cell lysate or culture medium by suitable conventional means.

Still a further aspect of the present invention is a process for isolating and purifying an MSF composition of the present invention or a fragment thereof, or a mixture of MSFs and fragments, from natural sources, e.g. urine or peripheral blood leukocytes. Alternatively, the MSFs may be isolated and purified from conditioned medium or cell lysate of cells expressing recombinant MSF protein.

Another aspect of this invention provides pharmaceutical compositions containing a therapeutically effective amount of one or more MSFs of the present invention. These pharmaceutical compositions may be employed in methods for treating disease states or disorders, for example, diseases characterized by a deficiency of platelets and other disorders referred to herein.

A further aspect of the invention, therefore, is a method for treating such disease states by administering to a patient a therapeutically effective amount of at least one MSF in a suitable pharmaceutical carrier. Alternatively, several MSFs may be administered in combination. These therapeutic methods may include administering in combination, simultaneously, or sequentially with an MSF, an effective amount of at least one other TPO-like factor, meg-CSF or other cytokine, e.g, IL-3 or steel factor; hematopoietin, interleukin, growth factor, or antibody.

Still another aspect of the present invention provides antibodies directed against an MSF of this invention. As part of this aspect, therefore, the invention includes cell lines capable of secreting such antibodies and methods for their production and use in diagnostic or therapeutic procedures.

Other aspects and advantages of the present invention will be apparent upon consideration of the following detailed description of preferred embodiments thereof.

BRIEF DESCRIPTION OF THE DRAWINGS

FIG. 1 is a cDNA sequence [SEQ ID NO: 1] encoding the MSF precursor [SEQ ID NO: 2] containing sequences found in human urinary meg-CSF, as well as sequences of other natural and artificial MSFs disclosed herein. Each of the twelve exons has been identified by alternating solid or dashed lines extending from above the first nucleotide in the DNA sequence encoded by that specific exon [SEQ ID NOS: 3, 5, 7, 9, 11, 13, 15, 17, 19, 21, 23 and 25]. The corresponding amino acid sequences appears below each codon [SEQ ID NOS: 4, 6, 8, 10, 12, 14, 16, 18, 20, 22, 24 and 26].

FIG. 3 is the modified nucleic acid sequence [SEQ ID NO: 27] of MSF-K130 which was used to produce the MSF as a fusion protein with thioredoxin in E.coli [SEQ ID NO: 28], as described in Example 5.

DETAILED DESCRIPTION OF THE INVENTION

Figure 2:
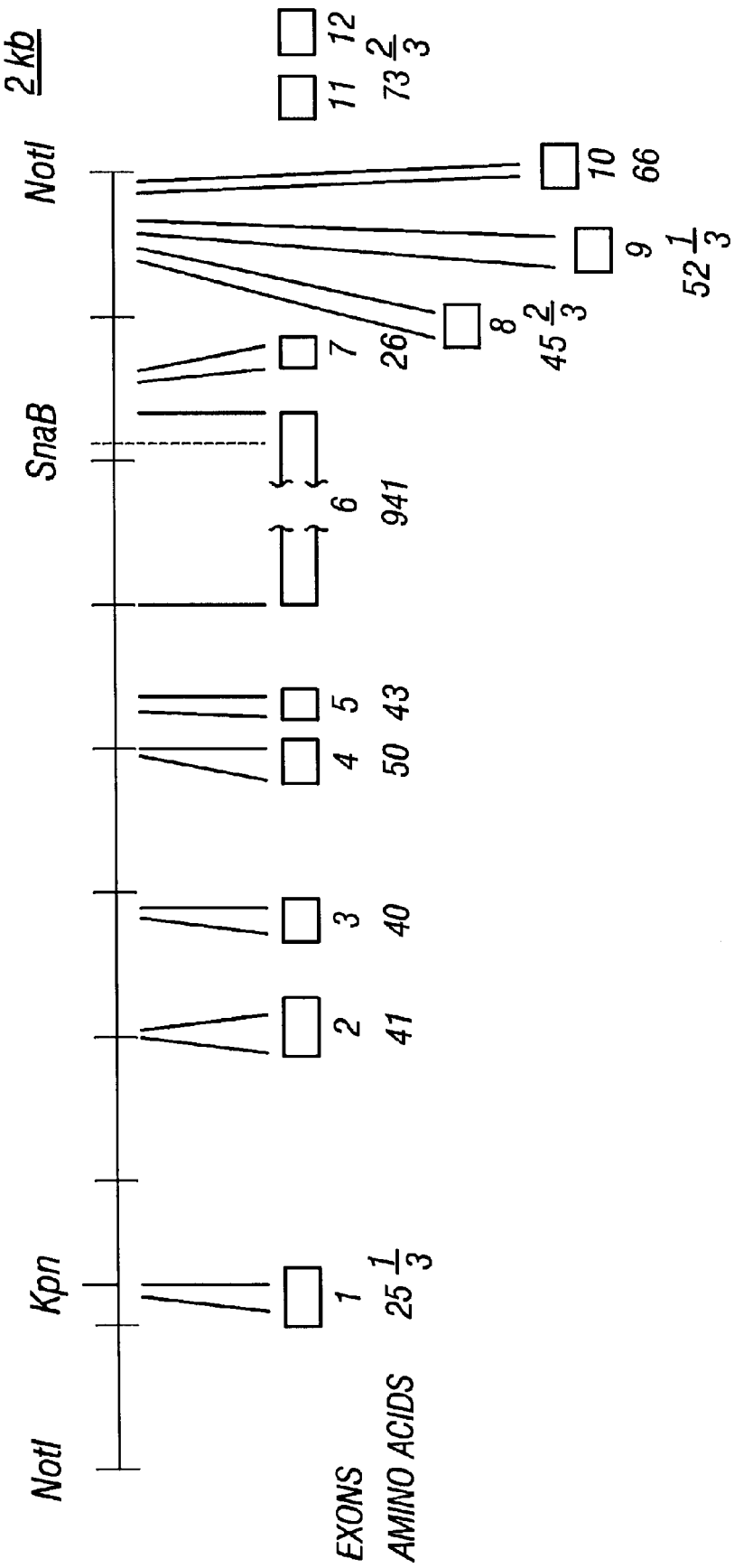
FIG. 2 is a bar graph illustrating the genomic organization of the MSF gene with reference to the number of amino acids encoded by each exon.

The novel family of human megakaryocyte stimulating factors (MSFs) provided by the present invention are protein or proteinaceous compositions substantially free of association with other human proteinaceous materials, contaminants or other substances with which the factors occur in nature. An MSF may be purified from natural sources as a homogeneous protein, or from a selected cell line secreting or expressing it. Mixtures of naturally occurring MSFs may be obtained from natural sources, or from selected cell lines by similar purification techniques. Another class of MSFs are "recombinant or genetically engineered proteins" which are defined herein as naturally occurring and non-naturally occurring proteins prepared by chemical synthesis and/or recombinant genetic engineering techniques, and/or a combination of both techniques. These MSFs may also be provided in optional association with amino acid residues and other substances with which they occur by virtue of expression of the factors in various expression systems. Recombinant or genetically-engineered MSFs of this invention may further be defined as including a polynucleotide of genomic, cDNA, semisynthetic, or synthetic origin with sequences from the meg-CSF DNA of FIG. 1 which, by virtue of its origin or manipulation: (1) is not associated with all or a portion of a polynucleotide with which it is associated in nature, (2) is linked to a polynucleotide other than that to which it is linked in nature, or (3) does not occur in nature.

The MSFs of the present invention include active fragments and alternatively spliced sequences derived from the DNA [SEQ ID NO: 1] and amino acid [SEQ ID NO: 2] sequences reported in FIG. 1 below. FIG. 1 is a cDNA sequence [SEQ ID NO: 1] of the precursor protein encoding urinary meg-CSF, as disclosed in published PCT patent application No. WO91/02001, and in U.S. patent application Ser. No. 07/643,502, which are incorporated by reference herein. The nucleotide sequences [SEQ ID NO: 1] and corresponding translated amino acids [SEQ ID NO: 2] of FIG. 1 are continuous in the largest identified cDNA [SEQ ID NO: 1] encoding the largest MSF protein [SEQ ID NO: 2], as indicated in the bar graph of FIG. 2. However in FIG. 1, each exon [SEQ ID NOS: 4, 6, 8, 10, 12, 14, 16, 18, 20, 22, 24 and 26] has been identified above the DNA sequence [SEQ ID NOS: 3, 5, 7, 9, 11, 13, 15, 17, 19, 21, 23 and 25, respectively] encoding that specific exon. While the sequence of FIG. 1 [SEQ ID NO: 1] is believed to be substantially complete, there may be additional, presently unidentified, exons occurring between Exons VI [SEQ ID NO: 14] and IX [SEQ ID NO: 20] or following Exon XII [SEQ ID NO: 26], which provide sequence for other members of the MSF family.

The exons of the meg-CSF gene [SEQ ID NOS: 4, 6, 8, 10, 12, 14, 16, 18, 20, 22, 24 and 26] were identified by analysis of CDNA clones from COS cells transfected with the gene or pieces of the gene or from cDNAs isolated from stimulated human peripheral blood lymphocytes. The first exon [SEQ ID NO: 4], containing the initiating methionine, encodes a classical mammalian protein secretion signal sequence. Exons II [SEQ ID NO: 6] through IV [SEQ ID NO: 8] contain the amino acid sequences of the original mature urinary meg-CSF protein which most likely terminates in a region between amino acid residues 134 and 205 of FIG. 1, based on amino acid sequence data from the native protein. More precisely, the mature human urinary meg-CSF protein terminates in the region between amino acid residues 134 and 147. Native meg-CSF is most likely generated by proteolytic cleavage (endolytic cleavage followed by endolytic and/or exolytic cleavage) at or near this site in larger precursor molecules containing additional amino acid sequences derived from one or more of Exons V [SEQ ID NO: 12] through XII [SEQ ID NO: 26].

Analysis of the nucleotide and amino acid sequences of all of the exons of the meg-CSF precursor gene [SEQ ID NOS: 3–26] have revealed some interesting relationships to other genes. Both Exons II [SEQ ID NO: 5 and 6] and III [SEQ ID NO: 7 and 8], which are related to each other, share significant sequence similarity with the somatomedin B domain of vitronectin and of PC-1 (a surface membrane glycoprotein found on plasma cells). The Cys-rich regions of Exons II [SEQ ID NO: 5 and 6] and III [SEQ ID NO: 7 and 8] are also related to similar sequences in placental protein 11, a putative serine protease. A sequence containing approximately 75 repeats of the sequence Lys-Pro-Thr which is present in Exon VI [SEQ ID NO: 13 and 14], resembles similar repeat sequences which have been found in membrane-bound glycoproteins and precursor proteins, such as spasmolysin.

Exons VI [SEQ ID NO: 13 and 14] through XII [SEQ ID NO: 25 and 26], in particular Exons VII [SEQ ID NO: 15 and 16], VIII [SEQ ID NO: 17 and 18] and IX [SEQ ID NO: 19 and 20], also contain sequences which are found in vitronectin distinct from the somatomedin B domain. These exons encode a sequence found in vitronectin and members of the collagenase family, e.g., human stromelysin. Another functional domain of vitronectin including the RGD adhesion sequence known to bind integrins is not found in any of the exons of the meg-CSF gene. The functions of the amino acid sequences from Exons V [SEQ ID NO: 11 and 12] through XII [SEQ ID NO: 25 and 26] have not yet been determined, but may play roles which effect the three dimensional structure, i.e., folding of the molecule.

During the course of the analysis of the structure of the 18.2 kb "meg-CSF" gene, it was discovered that the primary RNA transcript is spliced in a variety of ways to yield a family of mRNAs each encoding different MSF proteins. In addition, these precursor proteins can be processed in different ways to yield different mature MSF proteins. Thus, a family of MSF's exist in nature, including the meg-CSF which was isolated from urine from the bone marrow transplant patients. All members of this family are believed to be derived from the 18.2 kb meg-CSF gene plus a few additional exons, found in the peripheral blood leukocyte cDNA located just downstream from the 3' end of the 18.2 kb gene.

The entire 18.2 kb genomic sequence inserted as a NotI fragment in bacteriophage lambda DNA was deposited with the American Type Culture Collection, 12301 Parklawn Drive, Rockville, Md. 20852, USA under accession # ATCC 40856. The 3' PBL partial cDNA clone beginning one third of the way from the 5' end of Exon VI [SEQ ID NOS: 13 and 14] (containing the SnaB site) extending through Exon XII [SEQ ID NOS: 25 and 26] is stored at Genetics Institute, Inc. and can be readily made available without restrictions by deposit at the ATCC upon an indication of allowance of this application.

This invention also contemplates the construction of "recombinant or genetically-engineered" classes of MSFs, which may be generated using different combinations of the amino acid sequences [SEQ ID NOS: 4, 6, 8, 10, 12, 14, 16, 18, 20, 22, 24 and 26] of the exons of FIG. 1. Some of these novel MSFs may be easier to express and may have different biological properties than the native urinary meg-CSF.

Without being bound by, and based on analysis of the naturally occurring meg-CSF sequence of FIG. 1 [SEQ ID NO: 1 and 2], it is speculated that Exon I [SEQ ID NO: 3 and 4] is necessary for proper initiation and secretion of the MSF protein in mammalian cells; and that Exon XII [SEQ ID NO: 25 and 26] is necessary for termination of the translation of the naturally occurring protein. Exons II [SEQ ID NO: 5 and 6], III [SEQ ID NO: 7 and 8] and IV [SEQ ID NO: 9 and 10] are believed to contain the sequences essential to biological activity of the MSF. Exons V [SEQ ID NO: 11 and 12] and VI [SEQ ID NO: 13 and 14] may be related to activity of the factor, but are also implicated in the stability and binding of the molecule. Alternately spliced forms of MSF cDNAs containing either Exon V [SEQ ID NO: 11 and 12] or VI [SEQ ID NO: 13 and 14] have been observed. Exon V [SEQ ID NO: 11 and 12] and Exon VI [SEQ ID NO: 13 and 14] are also believed to play a role in the synergy of MSF with other cytokines. No alternative splicing has yet been observed between Exons VI [SEQ ID NO: 13 and 14] and XII [SEQ ID NO: 25 and 26]. However, such splicing in the region of Exons VI [SEQ ID NO: 13 and 14] through XII [SEQ ID NO: 25 and 26] may occur. Exons V [SEQ ID NO: 11 and 12] through XII [SEQ ID NO: 25 and 26] are believed to be implicated in the processing or folding of the appropriate structure of the resulting factor. For example, one or more of Exons V [SEQ ID NO: 11 and 12] through XII [SEQ ID NO: 25 and 26] may contain sequences which direct proteolytic cleavage, adhesion, or extracellular matrix processing.

Both naturally occurring MSFs and non-naturally-occurring MSFs may be characterized by various combinations of alternatively spliced exons of FIG. 1, with the exons spliced together in differing orders to form different members of the MSF family. At a minimum at least one of the group consisting of Exons II [SEQ ID NO: 5 and 6], III [SEQ ID NO: 7 and 8] and IV [SEQ ID NO: 9 and 10] and a biologically active fragment thereof is present in a MSF.

Naturally-occurring MSFs may possess at least Exon I [SEQ ID NO: 3 and 4], which contains both an initiating methionine necessary for translation and a secretory leader for secretion of the factor from mammalian cells, and one or more additional exons of FIG. 1. Of these additional exons, at least one is selected from the group consisting of Exons II [SEQ ID NO: 5 and 6], III [SEQ ID NO: 7 and 8] and IV [SEQ ID NO: 9 and 10], and a biologically active fragment thereof. An exemplary MSF [SEQ ID NO: 55 and 56] of this class includes a protein represented by the spliced-together arrangement of Exons I [SEQ ID NO: 3 and 4], II [SEQ ID NO: 5 and 6], III [SEQ ID NO: 7 and 8]. Still another exemplary MSF [SEQ ID NO: 57 and 58] of this class includes Exons I [SEQ ID NO: 3 and 4], III [SEQ ID NO: 5 and 6], V [SEQ ID NO: 11 and 12] and VI [SEQ ID NO: 13 and 14].

Other naturally occurring MSFs may possess both Exon I [SEQ ID NO: 3 and 4] and Exon XII [SEQ ID NO: 25 and 26], which latter exon contains a termination codon for translation, and at least one additional exon selected from Exons II [SEQ ID NO: 5 and 6], III [SEQ ID NO: 7 and 8] and IV [SEQ ID NO: 9 and 10], and a biologically active fragment thereof. It is speculated that both the initiating Met of Exon I [SEQ ID NO: 3 and 4] and the termination codon of Exon XII [SEQ ID NO: 25 and 26] are required to produce an active, properly folded, naturally-occurring MSF in a eukaryotic cell. Thus naturally-occurring MSFs may contain at least Exons I [SEQ ID NO: 3 and 4] and XII [SEQ ID NO: 25 and 26] and another exon. An exemplary MSF [SEQ ID NO: 61] of this class includes a protein [SEQ ID NO: 62] represented by the spliced-together arrangement of exons selected from Exons I through XII of FIG. 1 [SEQ ID NO: 3–26]. Still another exemplary MSF of this class [SEQ ID NO: 29] includes a protein [SEQ ID NO: 30] encoded by the spliced Exons I [SEQ ID NO: 3 and 4], II [SEQ ID NO: 5 and 6], III [SEQ ID NO: 7 and 8], IV [SEQ ID NO: 9 and 10], V [SEQ ID NO: 11 and 12] and XII [SEQ ID NO: 25 and 26]. Another MSF of this class [SEQ ID NO: 31 and 32] is formed by spliced together Exons I [SEQ ID NO: 3 and 4], II [SEQ ID NO: 5 and 6], III [SEQ ID NO: 7 and 8], IV [SEQ ID NO: 9 and 10] and XII [SEQ ID NO: 25 and 26]. Still another MSF [SEQ ID NO: 33 and 34] of this class includes the spliced together sequences of Exons I [SEQ ID NO: 3 and 4], II [SEQ ID NO: 5 and 6], III [SEQ ID NO: 7 and 8] and XII [SEQ ID NO: 25 and 26]. Another MSF sequence [SEQ ID NO: 35 and 36] is formed by spliced together Exons I [SEQ ID NO: 3 and 4], III [SEQ ID NO: 7 and 8] and XII [SEQ ID NO: 25 and 26]. Yet a further example of an MSF of this class [SEQ ID NO: 37 and 38] is formed by the spliced together arrangement of Exons I [SEQ ID NO: 3 and 4], III [SEQ ID NO: 7 and 8], IV [SEQ ID NO: 9 and 10] and XII [SEQ ID NO: 25 and 26].

Another class of naturally occurring MSFs may be characterized by the presence of Exon I [SEQ ID NO: 3 and 4], at least one of Exons II [SEQ ID NO: 5 and 6], III [SEQ ID NO: 7 and 8] and IV [SEQ ID NO: 9 and 10], or a biologically active fragment thereof, and all of Exons VI through XII [SEQ ID NOS: 13–26]. An exemplary MSF [SEQ ID NO: 39 and 40] of this class includes spliced together Exons I [SEQ ID NO: 3 and 4], II [SEQ ID NO: 5 and 6], III [SEQ ID NO: 7 and 8], IV [SEQ ID NO: 9 and 10], and VI through XII [SEQ ID NO: 13–26]. Another MSF of this class [SEQ ID NO: 41 and 42] is formed by spliced together Exons I [SEQ ID NO: 3 and 4], II [SEQ ID NO: 5 and 6], III [SEQ ID NO: 7 and 8], and VI through XII [SEQ ID NO: 13–26]. Still another MSF sequence [SEQ ID NO: 43 and 44] is formed from spliced together Exons I [SEQ ID NO: 3 and 4], III [SEQ ID NO: 7 and 8], and VI through XII [SEQ ID NO: 13–26]. Another MSF sequence [SEQ ID NO: 45 and 46] of this class includes spliced together Exons I [SEQ ID NO: 3 and 4], III [SEQ ID NO: 7 and 8], IV and VI through XII [SEQ ID NO: 13–26].

Still another class of naturally occurring MSFs may be characterized by the presence of Exon I [SEQ ID NO: 3 and 4], at least one of Exons II [SEQ ID NO: 5 and 6], III [SEQ ID NO: 7 and 8] and IV [SEQ ID NO: 9 and 10], and a biologically active fragment thereof; and Exons V through XII [SEQ ID NO: 11–26]. An exemplary MSF [SEQ ID NO: 47 and 48] of this class includes spliced together Exons I [SEQ ID NO: 3 and 4], II [SEQ ID NO: 5 and 6], III [SEQ ID NO: 7 and 8], and V through XII [SEQ ID NO: 11–26]. Another MSF [SEQ ID NO: 141 and 142] of this class is formed by spliced together Exons I [SEQ ID NO: 3 and 4], III [SEQ ID NO: 7 and 8], and V through XII [SEQ ID NO: 11–26]. Still another MSF [SEQ ID NO: 49 and 50] sequence is formed from spliced together Exons I [SEQ ID NO: 3 and 4], II [SEQ ID NO: 5 and 6], and V through XII [SEQ ID NO: 11–26]. Another MSF sequence [SEQ ID NO: 51 and 52] of this class includes spliced together Exons I [SEQ ID NO: 3 and 4], III [SEQ ID NO: 7 and 8], IV [SEQ ID NO: 9 and 10] and V through XII [SEQ ID NO: 11–26].

Another class of naturally occurring MSFs m be characterized by the presence of Exon I [SEQ ID NO 3 and 4], at least one of Exons II [SEQ ID NO: 5 and 6], III [SEQ ID NO: 7 and 8] and IV [SEQ ID NO: 9 and 10], and a biologically active fragment thereof; Exon V [SEQ ID NO: 11 and 12], and Exons VII through XII [SEQ ID NO: 15–26]. An exemplary MSF [SEQ ID NO: 53 and 54] of this class includes spliced together Exons I [SEQ ID NO: 3 and 4], II [SEQ ID NO: 5 and 6], III [SEQ ID NO: 7 and 8], IV [SEQ ID NO: 9 and 10], V [SEQ ID NO: 11 and 12] and VII through XII [SEQ ID NO: 15–26]. Another MSF of this class [SEQ ID NO: 63 and 64] is formed by Exons I [SEQ ID NO: 3 and 4], III [SEQ ID NO: 7 and 8], V [SEQ ID NO: 11 and 12] and VII through XII [SEQ ID NO: 15–26] in a spliced together form. Still another MSF sequence [SEQ ID NO: 65 and 66] is formed from spliced together Exons I [SEQ ID NO: 3 and 4], II [SEQ ID NO: 5 and 6], IV [SEQ ID NO: 9 and 10], V [SEQ ID NO: 11 and 12] and VII through XII [SEQ ID NO: 15–26]. Another MSF sequence [SEQ ID NO: 67 and 68] of this class includes Exons I [SEQ ID NO: 3 and 4], III [SEQ ID NO: 7 and 8], IV [SEQ ID NO: 9 and 10], V [SEQ ID NO: 11 and 12] and VII through XII [SEQ ID NO: 15–26] spliced together.

Yet another class of naturally occurring MSFs may be characterized by the presence of Exon I [SEQ ID NO: 3 and 4], at least one of Exons II [SEQ ID NO: 5 and 6], III [SEQ ID NO: 7 and 8] and IV [SEQ ID NO: 9 and 10] and a biologically active fragment thereof; at least one of Exons V through XI [SEQ ID NO: 11–24]; and Exon XII [SEQ ID NO: 25 and 26]. An exemplary MSF [SEQ ID NO: 69 and 70] of this class includes spliced together Exons I [SEQ ID NO: 3 and 4], II [SEQ ID NO: 5 and 6], III [SEQ ID NO: 7 and 8], IV [SEQ ID NO: 9 and 10], V [SEQ ID NO: 11 and 12], X [SEQ ID NO: 21 and 22] and XII [SEQ ID NO: 25 and 26]. Another MSF [SEQ ID NO: 71 and 72] of this class is formed by spliced together Exons I [SEQ ID NO: 3 and 4], II [SEQ ID NO: 5 and 6], III [SEQ ID NO: 7 and 8], VIII [SEQ ID NO: 17 and 18], IX [SEQ ID NO: 19 and 20] and XII [SEQ ID NO: 25 and 26]. Still another MSF sequence [SEQ ID NO: 73 and 74] is formed from spliced together Exons I [SEQ ID NO: 3 and 4], III [SEQ ID NO: 7 and 8], VI [SEQ ID NO: 13 and 14] and XII [SEQ ID NO: 25 and 26]. Another MSF sequence [SEQ ID NO: 75 and 76] of this class includes spliced together Exons I [SEQ ID NO: 3 and 4], II [SEQ ID NO: 5 and 6], IV [SEQ ID NO: 9 and 10], V

[SEQ ID NO: 11 and 12], VII [SEQ ID NO: 15 and 16] and XII [SEQ ID NO: 25 and 26].

For recombinant or genetically engineered MSFs, Exon I [SEQ ID NO: 3 and 4] may be replaced by a synthetic or heterologous sequence containing an initiating Met and a selected secretory leader designed for use in a selected expression system (hereafter referred to for simplicity as "artificial Exon I"). The natural Exon I [SEQ ID NO: 3 and 4] may be completely absent for intracellular expression in a bacterial host, such as E. coli. A secretory leader may be selected from among known sequences for secretion of proteins from a variety of host cells. A number of secretory leaders are known for bacterial cells, yeast cells, mammalian cells, insect cells and fungi which may be useful as host cells for expression of a recombinant or genetically-engineered MSF. The construction of an appropriate genetically engineered Exon I sequence containing a secretory leader and initiating Met is within the skill of the art with resort to known sequences and techniques. Thus, one class of recombinant MSFs may be characterized by a genetically-engineered Exon I in place of the naturally occurring Exon I [SEQ ID NO: 3 and 4] of FIG. 1.

Additionally, the termination codon supplied by Exon XII [SEQ ID NO: 25 and 26] to naturally occurring MSFs may be replaced by inserting into, or after, a selected exon of FIG. 1 a termination codon suitable to a selected host cell (hereafter referred to for simplicity as "artificial termination codon"). The construction of an appropriate MSF sequence containing a termination codon is within the skill of the art with resort to known codons for a variety of host cells and conventional techniques. Thus one class of recombinant MSFs may be characterized by the presence of an artificial termination codon.

One class of recombinant MSFs include a naturally-occurring Exon I [SEQ ID NO: 3 and 4], at least one of Exons II [SEQ ID NO: 5 and 6], III [SEQ ID NO: 7 and 8] and IV [SEQ ID NO: 9 and 10], and a biologically active fragment thereof; and an artificial termination codon. An example of such an MSF is MSF-K130 [SEQ ID NO: 77 and 78] and MSF-N141 [SEQ ID NO: 79 and 80], among others described in detail below.

Another class of recombinant MSFs include an artificial Exon I, at least one of Exons II [SEQ ID NO: 5 and 6], III [SEQ ID NO: 7 and 8] and IV [SEQ ID NO: 9 and 10], and a biologically active fragment thereof; and Exon XII [SEQ ID NO: 25 and 26].

Still another class of recombinant MSFs include an artificial Exon I, at least one of Exons II [SEQ ID NO: 5 and 6], III [SEQ ID NO: 7 and 8] and IV [SEQ ID NO: 9 and 10], and a biologically active fragment thereof; and an artificial termination codon.

Another class of recombinant, genetically-engineered MSFs include genetically-engineered Exon I, at least one of Exons II [SEQ ID NO: 5 and 6], III [SEQ ID NO: 7 and 8] and IV [SEQ ID NO: 9 and 10], and a biologically active fragment thereof; and all of Exons V through XII [SEQ ID NO: 11–26].

Still another class of recombinant MSFs may be characterized by the presence of genetically-engineered Exon I, at least one of Exons II [SEQ ID NO: 5 and 6], III [SEQ ID NO: 7 and 8] and IV [SEQ ID NO: 9 and 10], and a biologically active fragment thereof; and Exons VI through XII [SEQ ID NO: 13–26].

Another class of recombinant MSFs may be characterized by the presence of genetically-engineered Exon I, at least one of Exons II [SEQ ID NO: 5 and 6], III [SEQ ID NO: 7 and 8] and IV [SEQ ID NO: 9 and 10], and a biologically active fragment thereof; Exon V [SEQ ID NO: 11 and 12], and Exons VII through XII [SEQ ID NO: 15–26].

Yet another class of recombinant MSFs may be characterized by the presence of genetically-engineered Exon I, at least one of Exons II [SEQ ID NO: 5 and 6], III [SEQ ID NO: 7 and 8] and IV [SEQ ID NO: 9 and 10] and a biologically active fragment thereof; at least one of Exons V through XI [SEQ ID NO: 11–24]; and an artificial termination codon.

Another class of recombinant MSFs is characterized by genetically-engineered Exon I, at least one of Exons II [SEQ ID NO: 5 and 6], III [SEQ ID NO: 7 and 8] and IV [SEQ ID NO: 9 and 10], and a biologically active fragment thereof; all of Exons V through XI [SEQ ID NO: 11–24], with an artificial termination codon either inserted into, or added onto a selected last exon of the sequence.

Another class of recombinant MSFs is characterized by genetically-engineered Exon I, at least one of Exons II [SEQ ID NO: 5 and 6], III [SEQ ID NO: 7 and 8] and IV [SEQ ID NO: 9 and 10], and a biologically active fragment thereof; all of Exons VI through XI [SEQ ID NO: 13–24], with an artificial termination codon.

Another class of recombinant MSFs may be characterized by the presence of native Exon I [SEQ ID NO: 3 and 4], at least one of Exons II [SEQ ID NO: 5 and 6], III [SEQ ID NO: 7 and 8] and IV [SEQ ID NO: 9 and 10], and a biologically active fragment thereof, and all of Exons V through XI [SEQ ID NO: 11–24], with an artificial termination codon.

Still another class of recombinant MSFs may be characterized by the presence of Exon I [SEQ ID NO: 3 and 4], at least one of Exons II [SEQ ID NO: 5 and 6], III [SEQ ID NO: 7 and 8] and IV [SEQ ID NO: 9 and 10], and a biologically active fragment thereof; and all of Exons VI through XI [SEQ ID NO: 13–24], with an artificial termination codon.

Yet another class of recombinant MSFs may be characterized by the presence of Exon I [SEQ ID NO: 3 and 4], at least one of Exons II [SEQ ID NO: 5 and 6], III [SEQ ID NO: 7 and 8] and IV [SEQ ID NO: 9 and 10] and a biologically active fragment thereof; at least one of Exons V through XI [SEQ ID NO: 11–24]; and an artificial termination codon.

A further class of recombinant, genetically-engineered MSFs is characterized by the complete absence of an Exon I. Such MSFs are useful for intracellular expression in bacterial cells, such as E. coli. These MSFs may comprise at least one of Exons II [SEQ ID NO: 5 and 6], III [SEQ ID NO: 7 and 8] and IV [SEQ ID NO: 9 and 10] and a biologically active fragment thereof; optionally one or more exons from Exons V through XII [SEQ ID NO: 11–26]. In the absence of Exon XII [SEQ ID NO: 25 and 26], an artificial termination codon may be inserted into or after the last preferred carboxy terminal exon. Exemplary MSFs of this invention are MSF-234 [SEQ ID NO: 81 and 82] and MSF 236 [SEQ ID NO: 83 and 84] described below in detail.

In another class of naturally-occurring or non-naturally occurring MSFs, either the sequences of Exon VIII [SEQ ID NO: 17 and 18] and Exon IX [SEQ ID NO: 19 and 20] will be present together, or neither of these two exons will be present. This is primarily due to frame shifts between these exons and the remaining MSF exons.

Finally an MSF [SEQ ID NO: 61 and 62] exists which contains all twelve exons [SEQ ID NO: 3–26].

While the above described MSF sequence structures will provide for precursor MSFs capable of being processed naturally, or by a host cell expression system, into mature MSF proteins, it is considered that mature, processed form of the proteins produced in eukaryotic systems will be missing all or part of Exon I [SEQ ID NO: 3 and 4]. Perhaps the mature proteins may be missing a portion of Exon II [SEQ ID NO: 5 and 6] as well, in order to remove the leader sequence from the processed form. The processed forms of MSF proteins may also be missing substantial sequences from the carboxy terminus. For example, sequences from Exons V through XII [SEQ ID NO: 11–26] may be absent in mature, processed MSF proteins. As another example, sequences from Exons VI through XII [SEQ ID NO: 13–26] may be absent in mature, processed MSF proteins. As still another example, sequences from Exons VII through XII [SEQ ID NO: 15–26] may be absent in mature, processed MSF proteins. In such manner human urinary meg-CSF, an illustrative naturally-occurring MSF [SEQ ID NO: 81 and 82], has a mature protein sequence characterized by the presence of Exons II [SEQ ID NO: 5 and 6], III [SEQ ID NO: 7 and 8] and IV [SEQ ID NO: 9 and 10] in a predominantly homodimeric form.

Selected examples of artificial MSFs were prepared by the following methods. During the analysis of the meg-CSF gene, a contiguous cDNA was constructed containing Exons I through VI [SEQ ID NO: 3–14], in which the primary translation product was artificially interrupted by inserting artificial termination codons at different positions in Exons IV [SEQ ID NO: 9 and 10], V [SEQ ID NO: 11 and 12], and VI [SEQ ID NO: 13 and 14] near the point at which the original meg-CSF was believed to be processed, i.e. the region between amino acid residues 134 and 209. These cDNAs were transfected into COS cells and the resulting supernatants were tested for meg-CSF activity. Through this process, several different biologically active MSFs were identified.

One MSF of the present invention is characterized by the DNA sequence [SEQ ID NO: 77] extending from nucleotide number 1 of Exon I through nucleotide number 390 of Exon IV, encoding an amino acid sequence [SEQ ID NO: 78] which is a continuous fusion in frame extending from amino acid 1 of Exon I [SEQ ID NO: 3 and 4] through amino acid 130 of Exon IV [SEQ ID NO: 9 and 10] of the sequence of FIG. 1, with a termination codon inserted thereafter. The predicted molecular weight of this MSF [SEQ ID NO: 77 and 78] is approximately 11.6 kD. In 4–20% gradient sodium dodecyl sulfate polyacrylamide gel electrophoresis (SDS-PAGE), under reducing conditions, a major species of molecular weight of approximately 19 kD has been detected. This MSF [SEQ ID NO: 77 and 78] does not bind heparin under the standard binding conditions of 20 mM tris and pH 7.4. The construction and expression of this molecule, called MSF-K130 [SEQ ID NO: 77 and 78], is described in detail in Example 3.

Under SDS-PAGE non-reducing conditions, the molecular weight ranged from about 20 to about 50 kD. Upon expression in COS-1 cells, this MSF CDNA sequence [SEQ ID NO: 77] produces a mixture of monomeric and homo-dimeric species. The homodimer has exhibited activity in the fibrin clot assay of Example 8. In the inventors' hands, this is one of the most easily expressed MSF [SEQ ID NO: 77 and 78] which is also highly active in the fibrin clot assay. The MSF expressed by this sequence [SEQ ID NO: 77 and 78] in mammalian cells approximates the structure and properties of the native human urinary meg-CSF.

Another MSF of the present invention, called MSF-N141 [SEQ ID NO: 79 and 80], is characterized by a nucleotide sequence [SEQ ID NO: 79] extending from nucleotide number 1 of Exon I [SEQ ID NO: 3] through nucleotide number 423 of Exon IV [SEQ ID NO: 9], encoding an amino acid sequence [SEQ ID NO: 80] extending from amino acid 1 through amino acid 141 of the sequence of FIG. 1 with an artificial termination codon inserted thereafter. The predicted molecular weight of this MSF [SEQ ID NO: 79 and 80] is approximately 13.2 kD. In 4–20% SDS-PAGE under reducing conditions, a major species of molecular weight of approximately 21 kD has been detected. This MSF [SEQ ID NO: 79 and 80] binds heparin under standard binding conditions. Upon expression in COS-1 cells, this MSF CDNA sequence [SEQ ID NO: 79] produces a mixture of monomeric and homo-dimeric species. The monomeric form is the major form secreted by COS-1 cells. The COS cell conditioned medium from this transfection also yielded biological activity in the murine fibrin clot assay. The homodimeric form is the major species secreted by CHO cells.

Still another MSF of the present invention, MSF-S172 [SEQ ID NO: 87 and 88], is characterized by a nucleotide sequence [SEQ ID NO: 87] extending from nucleotide numbers 1 of Exon I through 516 of Exon V, encoding an amino acid sequence [SEQ ID NO: 88] extending from amino acid 1 through amino acid 172 of the sequence of FIG. 1 with an artificial termination codon inserted thereafter. The predicted molecular weight of this MSF [SEQ ID NO: 87 and 88] is approximately 16.2 kD, and in 4–20% SDS-PAGE under reducing conditions, a major species of molecular weight of approximately 23.5 kD has been detected. This MSF [SEQ ID NO: 87 and 88] also binds to heparin under standard binding conditions.

A further MSF of the present invention, MSF-R192 [SEQ ID NO: 89 and 90], is characterized by a nucleotide sequence [SEQ ID NO: 89] extending from nucleotide number 1 of Exon I through 576 of Exon V, encoding an amino acid sequence [SEQ ID NO: 90] extending from amino acid 1 through amino acid 192 of the sequence of FIG. 1 with an artificial termination codon inserted thereafter. The predicted molecular weight of this MSF [SEQ ID NO: 89 and 90] is approximately 18.4 kD, and in 4–20% SDS-PAGE under reducing conditions, a major species of molecular weight of approximately 27 kD has been detected. This MSF [SEQ ID NO: 89 and 90] also binds to heparin under standard conditions.

Yet another MSF of the present invention, called MSF-K204 [SEQ ID NO: 91 and 92], is characterized by a nucleotide sequence [SEQ ID NO: 91] extending from nucleotide numbers 1 of Exon I through 612 of Exon VI, encoding an amino acid sequence [SEQ ID NO: 92) extending from amino acid 1 through amino acid 204 of the sequence of FIG. 1. The predicted molecular weight of this MSF [SEQ ID NO: 91 and 92] is approximately 19.8 kD. In 4–20% SDS-PAGE under reducing conditions, a major species of molecular weight of approximately 28 kD has been detected. This MSF [SEQ ID NO: 91 and 92] also binds to heparin under standard conditions.

Still a further MSF of the present invention, called MSF-K209 [SEQ ID NO: 93 and 94], is characterized by a nucleotide sequence [SEQ ID NO: 93] extending from nucleotide numbers 1 of Exon I through 627 of Exon VI, encoding an amino acid sequence [SEQ ID NO: 94] extending from amino acid 1 through amino acid 209 of the sequence of FIG. 1 with an artificial termination codon inserted thereafter. The predicted molecular weight of this MSF [SEQ ID NO: 93 and 94] is approximately 20.4 kD, and in 4–20% SDS-PAGE under reducing conditions, a major species of molecular weight of approximately 29 kD has been detected. This MSF [SEQ ID NO: 93 and 94] also binds to heparin under standard conditions.

Another MSF of the present invention, MSF-D220 [SEQ ID NO: 95 and 96], is characterized by a nucleotide sequence [SEQ ID NO: 95] extending from nucleotide numbers 1 of Exon I through 660 of Exon VI, encoding an amino acid sequence [SEQ ID NO: 96] extending from amino acid 1 through amino acid 220 of the sequence of FIG. 1 with an artificial termination codon inserted thereafter. The predicted molecular weight of this MSF [SEQ ID NO: 95 and 96] is approximately 21.6 kD, and in 4–20% SDS-PAGE under reducing conditions, a major species of molecular weight of approximately 30 kD has been detected. This MSF [SEQ ID NO: 95 and 96] also binds to heparin under standard conditions.

Although in all of the above-described MSFs, the amino and carboxy termini of each MSF is defined precisely, it is to be understood that addition or deletion of one or several amino acids (and consequent DNA coding region) from either end of any of the MSFs (or from either end of any of the exons forming the spliced MSFs) is not likely to significantly alter the properties of the particular NSF. Such truncated MSFs which also retain MSF biological activities are also encompassed by this disclosure. The deliberate insertion of artificial termination codons at other positions in the MSF sequences can provide other members of the MSF family.

The alternatively spliced MSFs of the present invention are characterized by amino acid sequences containing at least two exons and less than twelve exons of FIG. 1 as described above, which exons are spliced together in various arrangements. Several representative "alternatively-spliced" naturally occurring MSF sequences have been identified by polymerase chain reaction (PCR) of cDNA prepared from various cell lines. The sequences of these MSFs were confirmed by hybridization to oligonucleotides spanning exon junctions, molecular weight of PCR fragments, and by DNA sequence in one case. A second method of obtaining MSF sequences involved natural isolation of cDNAs from a HeLa cDNA library. The molecular weights of these MSFs were calculated.

In the PCR technique, the primers extended across exon junctions between Exons I through VI [SEQ ID NO: 3–14]. Primers for use between Exons VI and XII [SEQ ID NO: 13–26]; are currently being designed. Therefore, these seven exons may all be present in these MSFs. Alternatively, no exon from Exon VI through XII [SEQ ID NO: 13–26] may be present. Still alternatively one or more of Exon VI through XII [SEQ ID NO: 13–26] may be present in these representative alternately spliced MSFs.

For example, the 5' end of one such MSF, called MSF-136 [SEQ ID NO: 97 and 98], identified by PCR is characterized by a contiguous amino acid sequence containing amino acid 1 to 25 of Exon I [SEQ ID NO: 4] (nucleotides 1 through 76 of FIG. 1 [SEQ ID NO: 3]) joined in frame to amino acid 67 to 106 of Exon III [SEQ ID NO: 8] (nucleotides 200 through 319 [SEQ ID NO: 7]), joined in frame to amino acid 200 to about 250 of Exon VI [SEQ ID NO: 100] (nucleotides 598 through about 748 [SEQ ID NO: 99]). Although not identified by a PCR primer, additional 3' sequence may be present in this MSF [SEQ ID NO: 97 and 98], as in each of the below described PCR-identified sequences. This 5' MSF sequence [SEQ ID NO: 97 and 98] has been detected in the cDNA of the following cell lines: the osteosarcoma cell line U20S (ATCC No. HTB96), the small cell lung carcinoma H128 (ATCC No. HTB120), the neuroblastoma SK-N-SH (ATCC No. HTB11), the neuroblastoma SK-N-MC (ATCC No. HTB10), the erythroleukemia cell line OCIM1, the erythroleukemia cell line K562 (ATCC No. CCL243) following culture in the presence or absence of phorbol myristate acetate, the hepatoma cell line HEPG2 (ATCC No. HB8065) and in stimulated peripheral blood leukocytes from normal volunteers (PBLs). The presence of this MSF-136 [SEQ ID NO: 97 and 98] indicates that a naturally-occurring alternately spliced MSF may comprise Exons I [SEQ ID NO: 3 and 4], III [SEQ ID NO: 7 and 8], VI [SEQ ID NO: 13 and 14] and optionally one or more of Exons VII through XII [SEQ ID NO: 15–26]. An artificial MSF mimicking this structure may have an artificial termination codon inserted within or after Exon VI [SEQ ID NO: 13 and 14].

Another PCR-identified 5' MSF sequence, called MSF-1236 [SEQ ID NO: 101 and 102], is characterized by a contiguous amino acid sequence [SEQ ID NO: 102] containing amino acid 1 to 25 [SEQ ID NO: 4] (nucleotides 1 through 76 [SEQ ID NO: 3]) of Exon I joined in frame to amino acid 26 to 66 [SEQ ID NO: 6] (nucleotides 77 through 199 [SEQ ID NO: 5]) of Exon II, joined in frame to amino acid 67 to 106 [SEQ ID NO: 8] (nucleotides 200 through 319 [SEQ ID NO: 7]) of Exon III, joined in frame to amino acid 200 to about 250 [SEQ ID NO: 100] (nucleotides 598 through about 748 [SEQ ID NO: 99]) of Exon VI. This 5' MSF sequence [SEQ ID NO: 101 and 102] has been detected by PCR analysis of the following cell lines: U20S, H128, SK-N-SH, SK-N-MC, the neuroglioma epithelial-like cell line H4 (ATCC No. HTB148), OCIM1, K562, K562 in the presence of PMA, the erythroleukemia cell line HEL (ATCC No. TIB180) in the presence of PMA, OCIM2, HEPG2 and stimulated PBLs. The presence of this MSF-1236 (SEQ ID NO: 101 and 102] indicates that a naturally-occurring alternately spliced MSF may comprise Exons I [SEQ ID NO: 3 and 4], II [SEQ ID NO: 5 and 6], III [SEQ ID NO: 7 and 8], VI [SEQ ID NO: 13 and 14] and optionally one or more of Exons VII through XII [SEQ ID NO: 15–26]. A recombinant MSF mimicking this structure may have an artificial termination codon inserted within or after Exon VI [SEQ ID NO: 13 and 14].

Still another MSF [SEQ ID NO: 103 and 104] according to this invention is characterized by a contiguous amino acid sequence containing amino acid 1 to 25 [SEQ ID NO: 4] (nucleotides 1 through 76 [SEQ ID NO: 3]) of Exon I joined in frame to amino acid 26 to 66 [SEQ ID NO: 6] (nucleotides 77 through 199 [SEQ ID NO: 5]) of Exon II, joined in frame to amino acid 67 to 106 [SEQ ID NO: 8] (nucleotides 200 through 319 [SEQ ID NO: 7]) of Exon III, joined in frame to amino acid 107 to 156 [SEQ ID NO: 10] (nucleotides 320 through 469 [SEQ ID NO: 9]) of Exon IV, joined in frame to amino acid 200 to 1140 [SEQ ID NO: 14] (nucleotides 598 through 3421 [SEQ ID NO: 13]) of Exon VI. This MSF-12346 [SEQ ID NO: 103 and 104] has been detected by PCR analysis of the following cell lines: U20S, SK-N-SH, SK-N-MC, OCIM1 in the presence of PMA, K562 in the presence of PMA, HEPG2 and stimulated PBLs. The presence of this MSF-12346 [SEQ ID NO: 103 and 104] indicates that a naturally-occurring alternately spliced MSF may comprise Exons I [SEQ ID NO: 3 and 4], II [SEQ ID NO: 5 and 6], III [SEQ ID NO: 7 and 8], IV [SEQ ID NO: 9 and 10], VI [SEQ ID NO: 13 and 14] and optionally one or more of Exons VII through XII [SEQ ID NO: 15–26]. A recombinant MSF mimicking this structure may have an artificial termination codon inserted within or after Exon VI [SEQ ID NO: 13 and 14].

Another MSF sequence of this invention may include MSF-1234, [SEQ ID NO: 105 and 106] characterized by a contiguous amino acid sequence containing amino acid 1 to 25 [SEQ ID NO: 4] (nucleotides 1 through 76 [SEQ ID NO: 3]) of Exon I (signal peptide) joined in frame to amino acid 26 to 66 [SEQ ID NO: 6] (nucleotides 77 through 199 [SEQ ID NO: 5]) of Exon II, joined in frame to amino acid 67 to 106 [SEQ ID NO: 8] (nucleotides 200 through 319 [SEQ ID NO: 7]) of Exon III, joined in frame to amino acid 107 to 156 [SEQ ID NO: 10] (nucleotides 320 through 469 [SEQ ID NO: 9]) of Exon IV. This sequence optionally has a 3' sequence comprising one or more of Exons V through XII [SEQ ID NO: 11–26]. This sequence may also contain an artificial termination codon inserted within or after any selected C-terminal exon.

Still another MSF sequence, MSF-134 [SEQ ID NO: 107 and 108], is characterized by a contiguous amino acid sequence containing amino acid 1 to 25 [SEQ ID NO: 4] (nucleotides 1 through 76 [SEQ ID NO: 3]) of Exon I (signal peptide) joined in frame to amino acid 67 to 106 [SEQ ID NO: 8] (nucleotides 200 through 319 [SEQ ID NO: 7]) of Exon III, joined in frame to amino acid 107 to 156 [SEQ ID NO: 10] (nucleotides 320 through 469 [SEQ ID NO: 9]) of Exon IV. This sequence [SEQ ID NO: 107 and 108] optionally has a 3' sequence comprising one or more of Exons V through XII [SEQ ID NO: 11–26]. This sequence [SEQ ID NO: 107 and 108] may also contain an artificial termination codon inserted within or after any selected C-terminal exon.

Two examples of MSFs that may be useful for bacterial intracellular expression include MSF-234 [SEQ ID NO: 81 and 82], characterized by a contiguous amino acid sequence containing amino acid 26 to 66 [SEQ ID NO: 6] (nucleotides 77 through 199 [SEQ ID NO: 5]) of Exon II joined in frame to amino acid 67 to 106 [SEQ ID NO: 8] (nucleotides 200 through 319 [SEQ ID NO: 7]) of Exon III, joined in frame to amino acid 107 to 156 [SEQ ID NO: 10] (nucleotides 320 through 469 [SEQ ID NO: 9]) of Exon IV; and MSF-236 [SEQ ID NO: 83 and 84], characterized by a contiguous amino acid sequence containing amino acid 26 to 66 [SEQ ID NO: 6] (nucleotides 77 through 199 [SEQ ID NO: 5]) of Exon II joined in frame to amino acid 67 to 106 [SEQ ID NO: 8] (nucleotides 200 through 319 [SEQ ID NO: 7]) of Exon III, joined in frame to amino acid 200 to 1140 [SEQ ID NO: 14] (nucleotides 598 through 3421 [SEQ ID NO: 13]) of Exon VI. These sequences [SEQ ID NOS: 81 and 82; SEQ ID NOS: 83 and 84] each optionally may have a 3' sequence comprising one or more of Exons V through XII [SEQ ID NO: 11–26]. These sequences [SEQ ID NOS: 81 and 82; SEQ ID NOS: 83 and 84] may also contain an artificial termination codon inserted within or after any selected C terminal exon.

It is further contemplated by the present invention that other MSFs which may be characterized by having MSF biological activities and which may be useful as research agents, diagnostic agents or as therapeutic agents, include factors having other combinations and arrangements of two or more of the exons identified in FIG. 1 [SEQ ID NO: 1 and 2]. The splicing of the exons to form recombinant MSFs may be accomplished by conventional genetic engineering techniques or chemical synthesis, as described herein.

Additionally, analogs of MSFs are included within the scope of this invention. An MSF analog may be a mutant or modified protein or polypeptide that retains MSF activity and preferably has a homology of at least about 50%, more preferably about 70%, and most preferably between about 90 to about 95% to human urinary meg-CSF. Still other MSF analogs are mutants that retain MSF activity and preferably have a homology of at least about 50%, more preferably about 80%, and most preferably between 90 to 95% to MSF-K130 [SEQ ID NO: 77 and 78] and the other truncated MSFs. Typically, such analogs differ by only 1, 2, 3, or 4 codon changes. Examples include MSFs with minor amino acid variations from the amino acid sequences of native or recombinant meg-CSF, or any of the above-described MSFs, in particular, conservative amino acid replacements. Conservative replacements are those that take place within a family of amino acids that are related in their side chains. Genetically encoded amino acids are generally divided into four families: (1) acidic=aspartate, glutamate; (2) basic= lysine, arginine, histidine; (3) non-polar=alanine, valine, leucine, isoleucine, proline, phenylalanine, methionine, tryptophan; and (4) uncharged polar=glycine, asparagine, glutamine, cystine, serine, threonine, tyrosine. Phenylalanine, tryptophan, and tyrosine are sometimes classified jointly as aromatic amino acids. For example, it is reasonable to expect that an isolated replacement of a leucine with an isoleucine or valine, an aspartate with a glutamate, a threonine with a serine, or a similar conservative replacement of an amino acid with a structurally related amino acid will not have a major effect on the MSF activity, especially if the replacement does not involve an amino acid at the active site of the MSF.

The MSFs of this invention may form monomers or homo- or hetero-dimers when expressed in suitable expression systems, due to the presence of cysteine-rich sequences in the exons. As indicated above, two specific homodimeric forms have been identified, namely the MSF-K130 [SEQ ID NO: 77 and 78] characterized by the sequence of amino acid 1 through 130 of FIG. 1, and the MSF-N141 [SEQ ID NO: 79 and 80] characterized by the sequence of amino acid 1 through 141 of FIG. 1. These homodimeric forms were found as abundant forms of these proteins. However, these proteins existed in mixtures of other dimeric and monomeric forms.

Other MSFs of this invention are predominantly monomers rather than mixtures, such as the MSFs characterized by the sequence of amino acids 1 through 209 of FIG. 1 [SEQ ID NO: 93 and 94], or amino acids 1 through 172 of FIG. 1 [SEQ ID NO: 87 and 88], among others.

MSFs of the present invention may act directly on megakaryocyte progenitor cells and/or megakaryocytes. MSFs may act indirectly on accessory cells, such as macrophages and T cells, to produce cytokines which stimulate megakaryocyte colony functions. Specifically, MSFs display megakaryocyte colony stimulating activity. Another MSF activity is the promotion of megakaryocyte maturation. The active MSF compositions of the present invention have biological activity in the murine fibrin clot megakaryocyte colony formation assay. For example, the MSF characterized by the amino acid sequence amino acid 1 of Exon I through amino acid 130 of Exon IV (MSF-K130) [SEQ ID NO: 77 and 78] has a specific activity of greater than approximately $1 \times 10^7$ dilution units/mg protein.

MSFs may also be used in synergy with other cytokines. For example, MSFs also display enhancement of IL-3-dependent megakaryocyte colony formation. MSFs may display enhancement of steel factor-dependent megakaryocyte colony formation [See, K. M. Zsebo et al, *Cell*, 63:195–201 (1990) for the identification of steel factor, also known as SCF. This document is incorporated by reference herein]. Together, these cytokines, IL-3 and steel factor, have been shown to stimulate increased megakaryocyte colony formation in vitro. In addition, IL-3 has been shown to elevate the level of platelets in non-human primates in vivo.

It is contemplated that all MSFs encoded by the combinations of sequences selected from Exons I through XII

[SEQ ID NO: 61 and 62] as reported above will have MSF biological activity, for example, activity in the murine fibrin clot assay, either alone or in combination with other cytokines. All modified or mutant MSF peptides or polypeptides of this invention, including the spliced forms of MSF, may be readily tested for activity in the megakaryocyte fibrin clot assay, either alone or in combination with other known cytokines including IL-3, steel factor or GM-CSF. Other cytokines which may be useful in combination with MSF include G-CSF, CSF-1, GM-CSF, IL-1, IL-4, erythropoietin, IL-6, TPO, M-CSF$_1$, CSF-$_1$, meg-CSF and IL-7.

These MSFs may also have biological or physiological activities in addition to the ability to stimulate the growth and development of colonies consisting of intermediate and large size megakaryocytes in culture in the assay using murine bone marrow target cells. In the murine fibrin clot megakaryocyte colony formation assay, an MSF composition of the present invention stimulates the growth of multiple colony types, but at least 50% of the colonies are pure megakaryocytic or mixed lineage colonies having significant numbers of megakaryocytes. The exact composition of colony types may vary with different assay conditions (fetal calf serum lots, etc). Among the megakaryocyte-containing colonies, typically 50–70% are pure megakaryocytic in composition.

In the murine agar megakaryocyte colony formation assay, an MSF of the present invention may stimulate colonies of megakaryocytes. In some cases, the particular MSF may not by itself stimulate megakaryocyte colony formation, but rather may enhance negakaryocyte colony formation supported by other factors, such as IL-3 or steel factor; or it may synergize with other factors, such as IL-11, which alone is not capable of supporting megakaryocyte colony formation in the fibrin clot assay.

It is presently anticipated that maximal biological activities of these MSFs in vitro may be achieved by activating the factors with acid, or denaturing conditions in SDS-PAGE, or by reverse phase high pressure chromatography (RP-HPLC). With both the native urinary protein and the recombinant MSF-K130 [SEQ ID NO: 77 and 78], an increase in the number of units of activity has been routinely detected after SDS-PAGE and RP-HPLC.

The present invention also encompasses MSF-encoding DNA sequences, free of association with sequences and substances with which the DNA occurs in natural sources. These DNA sequences, including the sequences reported in FIG. 1 [SEQ ID NO: 1 and 2] and identified above, code for the expression for MSF polypeptides. These sequences, when expressed in mammalian cells, yield precursor MSFs which are processed in the mammalian cells to yield functional proteins. Similar processing is expected to be seen in other non-mammalian expression systems.

Examples of MSF DNA sequences may include a DNA sequence comprising nucleotides 1 through 390 of FIG. 1 [SEQ ID NO: 77]. Another MSF DNA sequence comprises nucleotides 1 through 423 of FIG. 1 [SEQ ID NO: 79]. Another MSF DNA sequence comprises nucleotides 1 through 516 of FIG. 1 [SEQ ID NO: 87]. Yet another example of an MSF DNA sequence comprises nucleotides 1 through 576 of FIG. 1 [SEQ ID NO: 89]. Still a further illustration of an MSF DNA sequence comprises nucleotides 1 through 612 of FIG. 1 [SEQ ID NO: 91]. An additional MSF DNA sequence comprises nucleotides 1 through 627 of FIG. 1 [SEQ ID NO: 93]. An MSF DNA sequence may also comprise nucleotides 1 through 660 of FIG. 1 [SEQ ID NO: 95].

Other MSF DNA sequences include the 5' sequences of certain alternately spliced MSFs, such as a sequence [SEQ ID NO: 109] comprising nucleotides 1–76 of FIG. 1 [SEQ ID NO: 3] fused in frame to nucleotides 200–319 of FIG. 1 [SEQ ID NO: 7], fused in frame to nucleotides 598–748 of FIG. 1 [SEQ ID NO: 111]. Another such 5' DNA sequence [SEQ ID NO: 113 and 114] comprises nucleotides 1–319 of FIG. 1 [SEQ ID NO: 55] fused in frame to nucleotides 598–748 of FIG. 1 [SEQ ID NO: 111]. Still another DNA sequence [SEQ ID NO: 115] comprising nucleotides 1–469 of FIG. 1 [SEQ ID NO: 117] fused in frame to nucleotides 598–748 of FIG. 1 [SEQ ID NO: 111]. Another MSF DNA sequence [SEQ ID NO: 119] comprises nucleotides 1–76 of FIG. 1 [SEQ ID NO: 3] fused in frame to nucleotides 200–319 of FIG. 1 [SEQ ID NO: 7], fused in frame to nucleotides 598–748 of FIG. 1 [SEQ ID NO: 111]. Still another DNA sequence [SEQ ID NO: 117] extends from nucleotides 1 through 469 of FIG. 1. Another MSF DNA sequence [SEQ ID NO: 121] comprises nucleotides 1 to 76 of FIG. 1 [SEQ ID NO: 3] fused in frame to nucleotides 200 through 469 of FIG. 1 [SEQ ID NO: 7–9].

Other MSF DNA sequences which encode homo- or heterodimers of the above-described MSF DNA sequences or DNA sequences encoding a biologically active fragment of such sequences are also included in this invention. Similarly an allelic variation of the MSF DNA sequences, and a DNA sequence capable of hybridizing to any of MSF DNA sequences, which encodes a peptide or polypeptide having activity in the fibrin clot assay are also encompassed by this invention.

It is understood that the DNA sequences of this invention which encode biologically active human MSFs may also comprise DNA sequences capable of hybridizing under appropriate conditions, or which would be capable of hybridizing under said conditions, but for the degeneracy of the genetic code, to an isolated DNA sequence of FIG. 1 [SEQ ID NO: 1 and 2] or to active MSFs formed by alternate splicing of two or more exons of FIG. 1 as described above. These DNA sequences include those sequences encoding all or a fragment of the above-identified exon peptide sequences and those sequences which hybridize under stringent or relaxed hybridization conditions [see, T. Maniatis et al, *Molecular Cloning (A Laboratory Manual)*, Cold Spring Harbor Laboratory (1982), pages 387 to 389] to the MSF DNA sequences. An example of one such stringent hybridization condition is hybridization in 4×SSC at 65° C., followed by a washing in 0.1×SSC at 65° C. for an hour. Alternatively an exemplary stringent hybridization condition is in 50% formamide, 4×SSC at 50° C.

DNA sequences which hybridize to the sequences for an MSF under relaxed hybridization conditions and which code for the expression of MSF peptides having MSF biological properties also encode novel MSF polypeptides. Examples of such non-stringent hybridization conditions are 4×SSC at 50° C. or hybridization with 30–40% formamide at 42° C. For example, a DNA sequence which shares regions of significant homology, e.g., Exons II [SEQ ID NO: 5], III [SEQ ID NO: 7] or IV [SEQ ID NO: 9], and/or glycosylation sites or disulfide linkages, with the sequences of MSF and encodes a protein having one or more MSF biological property clearly encodes an MSF polypeptide even if such a DNA sequence would not stringently hybridize to the MSF sequences.

The DNA sequences of this invention may include or contain modifications in the non-coding sequences, signal sequences or coding sequences based on allelic variation among species, degeneracies of the genetic code or deliberate modification. Allelic variations are naturally-occurring base changes in the species population which may or may not result in an amino acid change. Degeneracies in the genetic code can result in DNA sequences which code for MSF polypeptides but which differ in codon sequence. Deliberate modifications can include variations in the DNA sequence of MSF which are caused by point mutations or by induced modifications to enhance the activity, half-life or production of the polypeptides encoded thereby. All such sequences are encompassed in the invention.

Utilizing the sequence data in FIG. 1 [SEQ ID NO: 1 and 2] and the exon combinations described above, as well as the denoted characteristics of MSF, it is within the skill of the art to modify DNA sequences encoding an MSF and the resulting amino acid sequences of MSF by resort to known techniques.

Modifications of interest in the MSF sequences may include the replacement, insertion or deletion of a selected nucleotide or amino acid residue in the coding sequences. For example, the structural gene may be manipulated by varying individual nucleotides, while retaining the correct amino acid(s), or the nucleotides may be varied, so as to change the amino acids, without loss of biological activity. Mutagenic techniques for such replacement, insertion or deletion, e.g., in vitro mutagenesis and primer repair, are well known to one skilled in the art [See, e.g., U.S. Pat. No. 4,518,584]. The encoding DNA of a naturally occurring MSF may be truncated at its 3'-terminus while retaining its biological activity. A recombinant, genetically-engineered MSF DNA sequence may be altered or truncated at both its 3' and 5' termini while retaining biological activity. It also may be desirable to remove the region encoding the signal sequence, and/or to replace it with a heterologous sequence. It may also be desirable to ligate a portion of the MSF sequence to a heterologous coding sequence, and thus to create a fusion peptide with the biological activity of MSF.

Specific mutations of the sequences of an MSF polypeptide may involve modifications of a glycosylation site. The absence of glycosylation or only partial glycosylation results from amino acid substitution or deletion at any asparagine-linked glycosylation recognition site or at any site of the molecule that is modified by addition of O-linked carbohydrate. An asparagine-linked glycosylation recognition site comprises a tripeptide sequence which is specifically recognized by appropriate cellular glycosylation enzymes. These tripeptide sequences are either Asn-X-Thr or Asn-X-Ser, where X can be any amino acid except proline. For example, such a site can be found in the cDNA illustrated in FIG. 1 [SEQ ID NO: 2] at amino acids #206–#208. A variety of amino acid substitutions or deletions at one or both of the first or third amino acid positions of a glycosylation recognition site (and/or amino acid deletion at the second position) results in non-glycosylation at the modified tripeptide sequence. Expression of such altered nucleotide sequences produces variants which are not glycosylated at that site.

Other analogs and derivatives of the sequence of an MSF which would be expected to retain MSF activity in whole or in part may also be easily made by one of skill in the art given the disclosures herein. One such modification may be the attachment of polyethylene glycol (PEG) onto existing lysine residues in an MSF sequence, as taught in U.S. Pat. No. 4,904,584, which is incorporated herein by reference. Alternatively, the insertion of one or more lysine residues or other amino acid residues that can react with PEG or PEG derivatives into the sequence by conventional techniques may enable the attachment of PEG moieties. Existing cysteines may be used according to techniques taught in published PCT Patent Application US90/02144, which is incorporated herein by reference. Such modifications are believed to be encompassed by this invention.

In addition to the above, other open reading frames (ORFS) or structural genes encoding MSFs may be obtained and/or created from cDNA libraries from other animal cell sources. For example, a murine MSF genomic clone and several partial MSF cDNA clones have been isolated by the inventors.

A naturally occurring MSF of this invention may be obtained as a single homogeneous protein or mixture of various alternately spliced MSF proteins and purified from natural sources. Among such natural sources are human urine or stimulated PBLs, other mammalian cell sources producing the factors naturally or upon induction with other factors from cell lines. The DNA of such MSFs may also be obtained and purified from natural sources.

To isolate and purify the naturally-occurring MSFs from natural sources, the purification technique comprises the following steps which are described in more detail in Example 1 below. The example and the following summary illustrate the purification for an exemplary naturally-occurring MSF, human urinary meg-CSF, which is isolated from human urine. For the urinary meg-CSF, the purification includes concentrating pooled bone marrow transplant patient urine through an Amicon YM-10 filter. The concentrated urine is passed through an anion exchange chromatographic column and the flow-through is bound onto a cation exchange chromatographic column. The urinary protein eluate is then subjected to pooling, dialyzing and heating and is applied to a lectin affinity chromatographic column. This eluate is then dialyzed and applied to a cation exchange fine performance liquid chromatography (FPLC) column. Finally this eluate is applied through three cycles of reverse phase high pressure liquid chromatography (HPLC) using different solvent systems for each HPLC run.

According to this purification scheme, batches with the highest levels of MSF in the murine fibrin clot assay, described below, are selected for further purification at the semi-preparative scale (between 30 and 100 liters urine equivalent) to maximize recovery and yield. Thus a homogeneous MSF, native meg-CSF, may be obtained by applying the purification procedures described in Example 1 to human urine or other sources of human MSF, e.g., activated PBLs.

Other tissue sources and cell lines from which naturally occurring MSFs may be isolated include HeLa cell lines, e.g. ATCC #098-AH2, and bone marrow cell lines, such as murine bone marrow cell line, FCM-1 [Genetics Institute, Inc., Cambridge, Mass.], osteosarcoma cell line U20S, small cell lung carcinoma H128, neuroblastoma SK-N-SH, neuroblastoma SK-N-MC, neuroglioma epithelial-like cell line H4, erythroleukemia cell line OCIM1 and OCIM2, erythroleukemia cell line K562 in the presence of PMA, erythroleukemia cell line HEL in the presence of PMA, and hepatoma cell line HEPG2. Procedures for culturing a cell source which may be found to produce an MSF are known to those of skill in the art.

The MSF proteins and the DNA sequences encoding MSFs of this invention can be produced via recombinant genetic engineering techniques and purified from a mammalian cell line which has been designed to secrete or express the MSF to enable large quantity production of pure, active MSFs useful for therapeutic applications. The proteins may also be expressed in bacterial cells, e.g., *E. coli*, and purified therefrom. The proteins may also be expressed and purified in yeast cells or in baculovirus or insect cells. Alternatively, an MSF or active fragments thereof may be chemically synthesized. An MSF may also be synthesized by a combination of the above-listed techniques. Suitable techniques for these different expression systems are known to those of skill in the art.

To produce a recombinant MSF, the DNA sequence encoding the factor can be introduced into any one of a variety of expression vectors to make an expression system capable of producing an MSF or one or more fragments thereof in a selected host cell.

The DNA sequences of the individual exons may be obtained by chemical synthesis or may be obtained from the following two deposits by standard restriction enzyme subcloning techniques or by the polymerase chain reaction (PCR) using synthetic primers for each exon based on the nucleotide sequences of FIG. 1 [SEQ ID NO: 1]. Two genomic clones containing meg-CSF sequences which may be used as sources of the MSF sequences have been deposited with the American Type Culture Collection, 12301 Parklawn Drive, Rockville, Md. 20852, USA in accordance with the requirements of the Budapest Treaty on the International Recognition of the Deposit of Microorganisms for the Purposes of Patent Procedure on Aug. 3, 1990.

An approximately 12 kb genomic fragment (referred to as Meg Kpn-SnaBI) containing the sequences spanning Exon I through part of Exon VI [See FIG. 2, the 5' KpnI site to the 3' SnaBI site] in an *E. coli* plasmid was given the accession number ATCC 40857. As described hereinbefore, the entire 18.2 kb sequence of spanning Exons I through Exon X (referred to as 18–5665) [SEQ ID NO: 3–22] inserted into bacteriophage lambda DNA was deposited under the accession number ATCC 40856. Exons XI and XII [SEQ ID NO: 13 and 25] may be made from the PBL derived cDNA clone stored at Genetics Institute, Inc., referred to above.

The MSF DNA obtained as described above or modified as described above may be introduced into a selected expression vector to make a recombinant molecule or vector for use in the method of expressing novel MSF polypeptides. These vectors contain the novel MSF DNA sequences recited herein, which alone or in combination with other sequences, code for MSF polypeptides of the invention or active fragments thereof. The vector employed in the method also contains selected regulatory sequences in operative association with the DNA coding sequences of the invention. Regulatory sequences preferably present in the selected vector include promoter fragments, terminator fragments and other suitable sequences which direct the expression of the protein in an appropriate host cell. The resulting vector is capable of directing the replication and expression of an MSF in selected host cells. The transformation of these vectors into appropriate host cells can result in expression of the MSF polypeptides.

Numerous types of appropriate expression vectors are known in the art for mammalian (including human) expression, as well as insect, yeast, fungal and bacterial expression, by standard molecular biology techniques. Mammalian cell expression vectors are desirable for expression. Bacterial cells, e.g., *E. coli*, are also desirable for expression of MSFs.

Mammalian cell expression vectors described herein may be synthesized by techniques well known to those skilled in this art. The components of the vectors, e.g. replicons, selection genes, enhancers, promoters, and the like, may be obtained from natural sources or synthesized by known procedures. See, Kaufman et al, *J. Mol. Biol.*, 159:511–521 (1982); and Kaufman, *Proc. Natl. Acad. Sci. USA*, 82:689–693 (1985). Alternatively, the vector DNA may include all or part of the bovine papilloma virus genome [Lusky et al, *Cell*, 36:391–401 (1984)] and be carried in cell lines such as C127 mouse cells as a stable episomal element.

One such vector for mammalian cells is pXM [Y. C. Yang et al, *Cell*, 47:3–10 (1986)]. This vector contains the SV40 origin of replication and enhancer, the adenovirus major late promoter, a cDNA copy of the adenovirus tripartite leader sequence, a small hybrid intervening sequence, an SV40 polyadenylation signal and the adenovirus VA I gene, in appropriate relationships to direct the high level expression of the desired cDNA in mammalian cells [See, e.g., Kaufman, *Proc. Natl. Acad. Sci. USA*, 82:689–693 (1985)]. To generate constructs for expression of MSF, the pXM vector is linearized with an appropriate restriction endonuclease enzyme and separately ligated to the cDNA encoding MSF which has been appropriately prepared by restriction endonuclease digestion, for example.

Another similar vector is pMT21. pMT21 is prepared by linearizing pMT2pc (which has been deposited with the ATCC under Accession Number 40348) by digestion with PstI. The DNA is then blunted using $T_4$ DNA polymerase. An oligonucleotide [SEQ ID NO: 123]:

TGCAGGCGAG CCTGAATTCC TCGA 24 is then ligated into the DNA, recreating the PstI site at the 5' end and adding an EcoRI site and XhoI site before the ATG of the DHFR CDNA. This plasmid is called pMT21. Preferably a desired polylinker with restriction sites for NotI, KpnI, SalI and SnabI is introduced into this vector for ready insertion of the MSF coding sequence.

Still another vector which may be employed to express MSF in CHO cells is pED4DPC-1. This vector is prepared from pED4, also known as pEMC2B1. As does pXM, described above, this vector contains the SV40 origin of replication and enhancer, the adenovirus major late promoter, a cDNA copy of the majority of the adenovirus tripartite leader sequence, a small hybrid intervening sequence, an SV40 polyadenylation signal and the adenovirus VA I gene, in appropriate relationships to direct the high level expression of the desired cDNA in mammalian cells. In addition, it contains DHFR and β-lactamase markers and an EMC sequence which pXM does not contain. To made pED4DPC-l, the sequence 1075 through 1096 is removed from pED4 to remove a stretch of cytosines. A new polylinker is added to introduce the restriction sites NotI, SalI and SnabI to the plasmid. The vector is linearized with an appropriate endonuclease enzyme and subsequently ligated separately to the cDNA encoding MSF.

These above-described vectors do not limit this invention, because one skilled in the art can also construct other useful mammalian expression vectors by, e.g., inserting the DNA sequence of the MSF from the plasmid with appropriate enzymes and employing well-known recombinant genetic engineering techniques and other known vectors, such as pJL3 and pJL4 [Gough et al., *EMBO J.*, 4:645–653 (1985)] and pMT2 (starting with pMT2-VWF, ATCC #67122; see PCT application PCT/US87/00033).

Once the vector is prepared, a selected host cell is transformed by conventional techniques with the vector containing MSF. The method of this present invention therefore comprises culturing a suitable cell or cell line, which has been transformed with a DNA sequence coding for expression of an MSF polypeptide under the control of known regulatory sequences.

Suitable cells or cell lines may be mammalian cells, such as Chinese hamster ovary cells (CHO) or the monkey COS-1 cell line. CHO cells are preferred as a mammalian host cell of choice for stable integration of the vector DNA, and for subsequent amplification of the integrated vector DNA, both by conventional methods. The selection of suitable mammalian host cells and methods for transformation, culture, amplification, screening and product production and purification are known in the art. See, e.g., Gething and Sambrook, Nature, 293:620–625 (1981), or alternatively, Kaufman et al, Mol. Cell. Biol., 5(7):1750–1759 (1985) or Howley et al, U.S. Pat. No. 4,419,446. Another suitable mammalian cell line is the CV-1 cell line. Further exemplary mammalian host cells include particularly primate cell lines and rodent cell lines, including transformed cell lines. Normal diploid cells, cell strains derived from in vitro culture of primary tissue, as well as primary explants, are also suitable. Candidate cells may be genotypically deficient in the selection gene, or may contain a dominantly acting selection gene. Other suitable mammalian cell lines include, but are not limited to, HeLa, mouse L-929 cells, 3T3 or 293 lines derived from Swiss, Balb-c or NIH mice, BHK or HaK hamster cell lines.

Similarly useful as host cells suitable for the present invention are bacterial cells. For example, the various strains of E. coli (e.g., HB101, MC1061 and strains used in the following examples) are well-known as host cells in the field of biotechnology. When used as host cells, E. coli permits the expression of the MSF protein as a single protein. MSF may also be expressed in bacterial cells as a fusion protein with thioredoxin, as disclosed in detail in U.S. patent application Ser. No. 07/652,531, which is incorporated herein by reference. Various strains of B. subtilis, Pseudomonas, other bacilli and the like may also be employed in this method.

Many strains of yeast cells known to those skilled in the art are also available as host cells for expression of the polypeptides of the present invention. Additionally, where desired, insect cells may be utilized as host cells in the method of the present invention. See, e.g. Miller et al, Genetic Engineering, 8:277–298 (Plenum Press 1986) and references cited therein. Fungal cells may also be employed as expression systems.

Once the MSF is expressed by the transformed and cultured cells, it is then recovered, isolated and purified from the culture medium (or from the cell, if expressed intracellularly) by appropriate means known to one of skill in the art.

A preferred purification procedure to isolate a recombinant or synthetic MSF from serum free mammalian cell (COS-1) conditioned medium is characterized by steps are similar to those for the purification of native meg-CSF from urine and are described in detail in Example 7. The recombinant MSF is concentrated from COS-1 cell supernatant through an Amicon YM-10 filter with a 10,000 Dalton molecular weight cut-off. The concentrate is dialyzed into 20 mm sodium acetate, pH4.5, and then applied to an S Toyopearl cation exchange FPLC column equilibrated in 20 mM sodium acetate, pH4.5. The bound material is then eluted from the column and applied through a cycle of C4 reverse phase HPLC using 0.1% TFA/acetonitrile as the solvent system. In the case of MSF-K130, the protein elutes between 20–30% of a buffer containing 0.1% TFA, 95% acetonitrile. Other non-naturally occurring MSFs described above may be obtained by applying this purification scheme described in detail in Example 7 for MSF-K130 [SEQ ID NO: 77 and 78].

MSF polypeptides may also be produced by known conventional chemical synthesis, e.g., by Merrifield synthesis or modifications thereof. Methods for constructing the polypeptides of the present invention by synthetic means are known to those of skill in the art. The synthetically-constructed MSF polypeptide sequences, by virtue of sharing primary, secondary, or tertiary structural and conformational characteristics with native MSF polypeptides may possess MSF biological properties in common therewith. Thus, they may be employed as biologically active or immunological substitutes for natural, purified MSF polypeptides in therapeutic and immunological processes.

One or more MSFs or active fragments thereof, purified in a homogeneous form or as a mixture of different MSFs from natural sources or produced recombinantly or synthetically, may be used in a pharmaceutical preparation or formulation. The MSF pharmaceutical compositions of the present invention or pharmaceutically effective fragments thereof may be employed in the treatment of immune deficiencies or disorders. MSFs may also be employed to treat deficiencies in hematopoietic progenitor or stem cells, or disorders relating thereto. MSFs may be employed in methods for treating cancer and other pathological states resulting from disease, exposure to radiation or drugs, and including for example, leukopenia, bacterial and viral infections, anemia, B cell or T cell deficiencies, including immune cell or hematopoietic cell deficiency following a bone marrow transplantation. MSFs may also be used to potentiate the immune response to a variety of vaccines creating longer lasting and more effective immunity. MSFs may be employed to stimulate development of B cells, as well as megakaryocytes.

The MSFs of the present invention may also have utility in stimulating platelet production, stimulating platelet recovery following chemotherapy or bone marrow transplantation, treating thrombocytopenia, aplastic anemia and other platelet disorders, preserving and extending the lifetime of platelets in storage, and stimulating platelet production in vitro for use in platelet transfusions. MSFs may also be employed to stimulate the growth and development of other colonies of hematopoietic and non-hematopoietic cells. Similarly, these factors may be useful in cell-targeting. MSF may also be useful in the treatment of wounds or burns, alone or with other wound-healing agents, such as fibroblast growth factor (FGF). Adhesion related therapeutic uses are also contemplated for MSFs of this invention. MSF compositions may be used as an adjunctive therapy for bone marrow transplant patients.

Therapeutic treatment of such platelet disorders or deficiencies with these MSF polypeptide compositions may avoid undesirable side effects caused by treatment with presently available serum-derived factors or transfusions of human platelets. It may also be possible to employ one or more active peptide fragments of MSF in such pharmaceutical formulations.

Therefore, as yet another aspect of the invention are therapeutic compositions for treating the conditions referred to above. Such compositions comprise a therapeutically effective amount of a MSF protein, a therapeutically effective fragment thereof, or a mixture of variously spliced or otherwise modified MSFs in admixture with a pharmaceutically acceptable carrier. This composition can be systemically administered parenterally. Alternatively, the composition may be administered intravenously. If desired, the composition may be administered subcutaneously. When systemically administered, the therapeutic composition for use in this invention is in the form of a pyrogen-free, parenterally acceptable aqueous solution. The preparation of such pharmaceutically acceptable protein solutions, having due regard to pH, isotonicity, stability and the like, is within the skill of the art.

The dosage regimen involved in a method for treating the above-described conditions will be determined by the attending physician considering various factors which modify the action of drugs, e.g. the condition, body weight, sex and diet of the patient, the severity of any infection, time of administration and other clinical factors. Generally, the daily regimen should be in the range of about 1 to about 1000 micrograms of MSF protein, mixture of MSF proteins or fragments thereof. Alternatively about 50 to about 50,000 units (i.e., one unit being the minimum concentration of MSF protein, or MSF protein mixture, which yields the maximal number of colonies in the murine fibrin clot megakaryocyte colony formation assay) of MSF protein per kilogram of body weight may be a desirable dosage range.

The therapeutic method, compositions, purified proteins and polypeptides of the present invention may also be employed, alone or in combination with other cytokines, hematopoietins, interleukins, growth factors or antibodies in the treatment of disease states characterized by other symptoms as well as platelet deficiencies. It is anticipated that an MSF, if it does not itself have TPO activity, will prove useful in treating some forms of thrombocytopenia in combination with general stimulators of hematopoiesis, such as IL-3, IL-6, GM-CSF, steel factor, IL-11 (described in co-owned copending U.S. patent application Ser. No. 07/526,474 and in published PCT Patent Application No. WO91/07495, both incorporated herein by reference) or with other megakaryocytic stimulatory factors or molecules with TPO-like activity. Additional exemplary cytokines or hematopoietins for such co-administration include TPO, G-CSF, the CSF-ls (including M-CSF), IL-1, IL-4, IL-7, erythropoietin, and variants of all of these cytokines, or a combination of multiple cytokines. The dosage recited above would be adjusted to compensate for such additional components in the therapeutic composition. For example, the MSF may be administered in amounts from 1 to 1000 µg/kg body weight and the other cytokine may be administered in the same amounts in such a co-administration protocol. Alternatively, co-administration may permit lesser amounts of each therapeutic agent to be administered. Progress of the treated patient can be monitored by conventional methods.

Other uses for these novel proteins and recombinant polypeptides are in the development of antibodies generated by standard methods for in vivo or in vitro diagnostic or therapeutic use. As diagnostic or research reagents, antibodies generated against these MSFs may also be useful in affinity columns and the like to further purify and identify the complete meg-CSF protein. Such antibodies may include both monoclonal and polyclonal antibodies, as well as chimeric antibodies or "recombinant" antibodies generated by known techniques.

The antibodies of the present invention may be utilized for in vivo and in vitro diagnostic purposes, such as by associating the antibodies with detectable labels or label systems. Alternatively these antibodies may be employed for in vivo and in vitro therapeutic purposes, such as by association with certain toxic or therapeutic compounds or moieties known to those of skill in this art. These antibodies also have utility as research reagents.

Also provided by this invention are the cell lines generated by presenting MSF or a fragment thereof as an antigen to a selected mammal, followed by fusing cells of the animal with certain cancer cells to create immortalized cell lines by known techniques. The methods employed to generate such cell lines and antibodies directed against all or portions of a human MSF protein or recombinant polypeptide of the present invention are also encompassed by this invention.

The following examples illustratively describe the purification and characteristics of homogeneous human MSF and other methods and products of the present invention. These examples are for illustration and are not intended to limit the scope of the present invention.

EXAMPLE 1

Purification of Native Meg-CSF from Urine

The following procedures are employed to obtain native meg-CSF protein from urine of human bone marrow transplant patients. The same or similar procedure may be employed to purify other MSFs from natural sources. Urine from patients with aplastic anemia or thrombocytopenia accompanying other disease states may also be used as the source of the factor employing this purification.

STEP 1: Urine was collected from bone marrow transplant patients between days 5 and 18 following transplant. One hundred liters of pooled urine were treated with protease inhibitors phenylmethyl-sulfonylfluoride (PMSF) and ethylenediaminetetraacetic acid (EDTA). This pooled urine was concentrated on an Amicon YM-10 filter (10,000 molecular weight cut-off) to remove excess pigments and reduce the volume. A cocktail of protease inhibitors [leupeptin, aprotinin, ethylene glycol-bis-tetraacetic acid (EGTA) and N-ethylmaleimide (NEM)] was added to the urine at this step and the next three steps to minimize proteolysis. The pH of the urine concentrate was adjusted to 8.0 and diluted to a conductivity of 7 mS/cm.

STEP 2: The retentate from this first step of the purification was then subjected to anion exchange column chromatography on a QAE Zetaprep [Cuno] at pH 8.0. The QAE flow-through was adjusted to a pH4.5 with 1M acetic acid.

STEP 3: The flow-through from the second purification step was bound to a cation exchange chromatographic column, an SP-Zetaprep column [Cuno] at pH 4.5. Bound protein containing Meg-CSF was eluted with 1M NaCl at a pH of 4.5. The eluate was pooled, protease inhibitors were added as above and the bound protein was either neutralized to pH7 and stored at −80° C. until further chromatography was performed or dialyzed into a Tris-buffered saline (TBS) solution, with the addition of the protease inhibitors described in Step 1. This dialyzate was heated at 56° C. for 30 minutes. Addition of the protease inhibitors, while not essential for recovery of protein, enabled greater amount of protein to be recovered from this step, not denatured by the proteases in the system. Pools from this step were also analyzed for the presence of megakaryocyte-specific growth factors. These pools were found to contain Meg-CSF activity.

STEP 4: The resulting material was added to a lectin affinity chromatographic column, a Wheat Germ Sepharose column [Pharmacia]. Urinary Meg-CSF was found to bind to this column. This protein was then eluted with 0.25 M N-acetyl glucosamine (N-acglcNH$_2$) in TBS, and dialyzed against 20 mM sodium acetate, pH 4.5 in the presence of the protease inhibitors of Step 1.

STEP 5: This dialysate was applied to a 10 ml S-Toyopearl FPLC cation exchange column and eluted using a linear gradient of 0 to 1M NaCl in 20 mM sodium acetate at pH 4.5. The protein eluted from this step was tested for Meg-CSF activity in the fibrin clot assay described below. The Meg-CSF activity was observed to elute in two discrete peaks. The major activity eluted between 0.1M and 0.25M NaCl. A minor, but reproducible activity eluted between 0.3M and 0.5N NaCl. The two activities may be due to protein or carbohydrate modification of a single protein; however the data presented further herein refers to the major protein.

STEP 6: The eluate from this fifth purification step was then purified on a reverse phase HPLC (C4) column [Vydac; 1 cm×25 cm] which was eluted with a linear gradient of between 23–33% acetonitrile in 0.1% trifluoroacetic acid (TFA). This step removes an abundant 30 Kd protein contaminant. Recombinant MSF elutes at a slightly lower gradient of about 20 to about 30% of the buffer.

STEP 7: The HPLC step was repeated in a different solvent system, after the eluate of Step 6 was diluted with two parts acetic acid and pyridine. The purified material eluted between 6–15% n-propanol in pyridine and acetic acid on a C18 reverse phase HPLC column (0.46×25 cm). The material produced after this step, when assayed gave the specific activity of greater than $5 \times 10^7$ dilution units reported in the murine assay. This optional step removes the bulk of urinary ribonuclease, a major contaminant, from the preparation.

STEP 8: The HPLC step was repeated once more on a C4 column (Vydac; 0.46×25 cm) using 0.15% HFBA in acetonitrile. The material eluted between 27–37% acetonitrile. The last HPLC step removed substantially all remaining ribonuclease and proteinaceous contaminants present after Step 7.

This purified meg-CSF material was then analyzed by SDS-PAGE, bioassayed and labelled with $^{125}$I. Homogenous protein is obtained from this procedure, omitting step 7, having a specific activity ranging from about $5 \times 10^7$ to about $2-5 \times 10^8$ dilution units per mg protein in the murine megakaryocyte colony assay described below. A unit of activity is defined as the reciprocal of the maximum dilution which stimulates the maximum number of megakaryocyte colonies per ml.

This process is preferably used to purify any naturally occurring MSF protein, or mixture thereof, from a natural source.

EXAMPLE 2

Analysis of Genomic MSF, Meg-CSF

A preliminary analysis of COS supernatant expressing the Kpn-SnaB 112 kb genomic subclone was performed previously, and indicated that a protein which reacted with MSF-specific antibodies was expressed by COS cells and was secreted into the culture medium. Dialysed, concentrated cell supernatant was variably active in the murine meg-colony assay.

Analysis by Northern and Western indicated that the level of MSF mRNA and protein was very low. A Western immunoblot of the protein from COS supernatant expressed in conditioned medium revealed the presence of three heterogenous species which specifically bind anti-meg CSF peptide antibodies and the binding can be competed with excess peptide. The molecular weights of these species, 200 kD, 30 kD, and 14 kD, are different from the partially purified meg-CSF from the BMT urine which has an apparent molecular weight ranging between about 18–about 28 kD under reducing conditions.

EXAMPLE 3

Mammalian Cell Expression of MSF-K130

Recombinant MSFs were obtained by the following techniques. Six MSF cDNA clones, truncated at putative MSF protein processing sites in Exons V and VI, were constructed by using the polymerase chain reaction. A seventh clone, MSF-K130 [SEQ ID NO: 77 and 78], was isolated as a consequence during the PCR reaction by the inadvertent insertion of an artificial termination codon in Exon IV after amino acid 130. Seven oligonucleotide primers were synthesized as follows:

(1) CGCGCGGCCGCGACTATTCG [SEQ ID NO: 124]
(2) GCGCTCGAGCTAAGAGGAGGAGGA [SEQ ID NO: 125]
(3) GCGCTCGAGCTATCTATTAGCAGC [SEQ ID NO: 126]
(4) GCGCTCGAGCTACTTGTTATCTTT [SEQ ID NO: 127]
(5) GCGCTCGAGCTAATCTACAACTGG [SEQ ID NO: 128]
(6) GCGCTCGAGCTAGTTTGGTGGTTT [SEQ ID NO: 129]
(7) GCGCTCGAGCTAAGTTCTGTTCTT [SEQ ID NO: 130]

Primer (1) was designed to hybridize to the CDNA flanking the initiating methionine codon and contains nine MSF-homologous nucleotides, a NotI restriction endonuclease site and three additional nucleotides to enhance restriction endonuclease recognition (as suggested in the New England Biolabs catalog).

The remaining oligonucleotide primers were designed to hybridize to the 3' regions of the cDNA and to flank the putative MSF protein processing site codons for [SEQ ID NO: 87] MSF-S172 (2), [SEQ ID NO: 89] MSF-R192 (3), [SEQ ID NO: 91] MSF-K204 (4), [SEQ ID NO: 77] MSF-K130 and [SEQ ID NO: 95] D220 (5), [SEQ ID NO: 79] N141 (6) and [SEQ ID NO: 131] T208 (7). The 3' primers contain twelve nucleotides of MSF-homologous sequence, a translation termination codon, an XhoI restriction endonuclease site and three additional nucleotides to enhance restriction endonuclease recognition.

Six PCR reactions were performed in duplicate, using the conditions recommended by Perkin-Elmer Cetus Corp. Each of the six duplicate reactions contained the 5' primer (No. 1, 1.0 μM), one of the 3' primers (1.0 μM) and 1 ng of MSF cDNA as template. The reactions were carried through two rounds of eighteen cycles each. One cycle consisted of a two minute denaturation of 95° C. followed by three minutes of annealing/extension of 72° C. After the first round of eighteen cycles, 10 μl of the first reaction was transferred to a fresh reaction mixture (100 μl total), and the amplification cycles were repeated. The PCR products generated by the second round of amplification reactions (twelve in all) were digested with NotI and XhoI, using conditions described by the vendor, and fractionated by agarose gel electrophoresis.

To obtain expression of these truncated MSFs in mammalian host cells, the appropriate DNA bands were then excised and ligated into a NotI and XhoI digested pMT21-2 vector. The vector pMT21-2 is identical to the vector pMT21 except for the polylinker region, containing PstI, NotI, KpnI, ApaI, EcoRV, EcoRI and XhoI sites, which was changed to facilitate cloning of MSF DNA fragments. Competent DH5 cells were transformed with the recombinant plasmid and selected for resistance to ampicillin. Plasmid DNA was prepared from transformed cells and sequenced with selected internal oligonucleotides across the MSF insert. All the above techniques are conventional and described in Sambrook et al, cited above.

The clones listed above were identified as having the correct nucleotide sequence to encode the desired MSF proteins. For example, S172 [SEQ ID NO: 87] encodes MSF amino acids 1–172 [SEQ ID NO: 88], terminating with a serine residue. Position 173 encodes a translation termination codon. The exception was one of the two reactions designed to synthesize D220 [SEQ ID NO: 95 and 96]. During this PCR reaction, a serendipitous deletion of nucleotide 392 of the cDNA sequence resulted in clone MSF-K130 [SEQ ID NO: 77], which encodes MSF amino acids 1–130 [SEQ ID NO: 78] and terminates in a lysine followed by a TAA stop codon. Clone MSF-K130 [SEQ ID NO: 77 and 78] may readily be deliberately synthesized by a PCR reaction designed for this purpose. This would require using an oligonucleotide primer similar in design to the other 3' primer oligonucleotides, i.e., an oligonucleotide containing twelve nucleotides of MSF-homologous sequence, a translation termination codon, an XhoI restriction site and a few additional nucleotides to enhance restriction endonuclease recognition. An example of a suitable 3' primer would be the following sequence: SEQ ID NO: 133 GCGCTC-GAGCTAATTTGATGGTTT.

The pMT21-2 plasmid, containing the MSF DNA sequence is transfected onto COS cells. The conditioned medium from the transfected COS cells contains MSF biological activity as measured in the murine assays. Similarly the modified pED4DPC-1 construct containing the cDNA for MSF is transfected into CHO cells.

The vector pED4DPC-1 may be derived from pMT21 vector. pMT21 is cut with EcoRI and XhoI which cleaves the plasmid at two adjacent cloning sites. An EMCV fragment of 508 base pairs is cut from pMT$_2$ECAT$_1$ [S. K. Jong et al, *J. Virol.*, 63:1651–1660 (1989)] with the restriction enzymes EcoRI and taqαI. A pair of oligonucleotides 68 nucleotides in length are synthesized to duplicate the EMCV sequence up to the ATG. The ATG is changed to an ATT, and a C is added, creating a XhoI site at the 3' end. A taqαI site is situated at the 5' end. The sequences of the oligonucleotides are [SEQ ID NO: 134]:
CGAGGTTAAA AAACGTCTAG GCCCCCCGAA CCACGGGGAC 40
GTGGTTTTCC TTTGAAAAAC ACGATTGC 68 and the respective complementary strands.

Ligation of the pMT21 EcoRI-to-XhoI fragment to the EMCV EcoRI-to-taqαI fragment and to the taqαI/XhoI oligonucleotides produces the vector pED4. A polylinker, containing PstI, NotI, SalI, SnaBI and EcoRI sites, is inserted into this vector as described above to create pED4PC-1.

Stable transformants are then screened for expression of the product by standard immunological, biological or enzymatic assays, such as those described below in Example 8. The presence of the DNA and mRNA encoding the MSF polypeptides is detected by standard procedures such as Southern and Northern blotting. Transient expression of the DNA encoding the polypeptides during the several days after introduction of the expression vector DNA into suitable host cells is measured without selection by activity or immunologic assay, e.g., the murine fibrin clot assay, of the proteins in the culture medium.

EXAMPLE 4

Bacterial Expression Systems

One skilled in the art could manipulate the sequences encoding the MSF polypeptide by eliminating any human regulatory sequences flanking the coding sequences, eliminating the mammalian secretory sequence of Exon I, and inserting bacterial regulatory sequences to create bacterial vectors for intracellular or extracellular expression of the MSF polypeptide of the invention by bacterial cells. The DNA encoding the polypeptides may be further modified to contain different codons to optimize bacterial expression as is known in the art.

The sequences encoding the mature MSF are operatively linked in-frame to nucleotide sequences encoding a secretory leader polypeptide permitting bacterial expression, secretion and processing of the mature MSF polypeptides, also by methods known in the art. The expression of MSF in *E. coli* using such secretion systems is expected to result in the secretion of the active polypeptide. This approach has yielded active chimeric antibody fragments [See, e.g., Bitter et al, *Science*, 240:1041–1043 (1983)].

Alternatively, the MSF may be expressed as a cytoplasmic protein in *E. coli*, either directly or as a carboxy terminal fusion to proteins, such as thioredoxin, which can maintain many peptides in soluble form in *E. coli*. The fusion proteins can be cleaved and the free MSF isolated using enzymatic cleavage (enterokinase, Factor Xa) or chemical cleavage (hydroxylamine) depending on the amino acid sequence used to fuse the molecules.

If the cytoplasmic MSF or MSF fusion protein is expressed in inclusion bodies, then either molecule would most likely have to be refolded after complete denaturation with guanidine hydrochloride and a reducing agent a process also known in the art. For procedures for isolation and refolding of intracellularly expressed proteins, see, for example, U.S. Pat. No. 4,512,922. If either MSF protein or MSF-fusion protein remain in solution after expression in *E. coli*, they are likely to not require denaturation but only mild oxidation to generate the correct disulfide bridges.

The compounds expressed through either route in bacterial host cells may then be recovered, purified, and/or characterized with respect to physicochemical, biochemical and/or clinical parameters, all by known methods.

EXAMPLE 5

Thioredoxin-MSF Fusion Expression

An MSF can be expressed at high levels in *E. coli* as a thioredoxin fusion protein using the modified expression vector similar to pALtrxA/EK/IL11ΔPro-581 described in pending U.S. patent application Ser. No. 07/652,351.

As one such example, MSF-K130 [SEQ ID NO: 77 and 78] was employed. For expression in *E. coli*, the first 25 amino acids of Exon I [SEQ ID NO: 3 and 4] which encode the secretory leader, were removed from the MSF-K130 sequence [SEQ ID NO: 77 and 78]. An enterokinase site, which is [SEQ ID NO: 143] Asp Asp Asp Asp Lys, was inserted at the 5' end of Exon II [SEQ ID NO: 5 and 6] of MSF-K130. Additionally, the N-terminal Asp of MSF was deleted and replaced with the dipeptide Asn-Gly, encoded by the sequence AACGGT, which encodes a hydroxylamine cleavage site. The sequence of MSF-K130 [SEQ ID NO: 77 and 78] which was added as a fusion to thioredoxin, and which contained certain codon changes for preferred expression in *E. coli* is shown in FIG. 3 [SEQ ID NO: 27 and 28].

The plasmid expression vector used for expression is a modified pALtrxA/EK/IL11ΔPro-581, illustrated in FIG. 1 of the above-referenced application. This plasmid contains the following principal features:

Nucleotides 1–2060 contain DNA sequences originating from the plasmid pUC-18 [Norrander et al, *Gene*, 26: 101–106 (1983)] including sequences containing the gene for β-lactamase which confers resistance to the antibiotic ampicillin in host *E. coli* strains, and a colE1-derived origin of replication. Nucleotides 2061–2221 contain DNA sequences for the major leftward promoter (pL) of bacteriophage λ [Sanger et al, *J. Mol. Biol.*, 162:729–773 (1982)], including three operator sequences, $O_L1$, $O_L2$ and $O_L3$. The operators are the binding sites for λcI repressor protein, intracellular levels of which control the amount of transcription initiation from pL. Nucleotides 2222–2241 contain a strong ribosome binding sequence derived from that of gene 10 of bacteriophage T7 [Dunn and Studier *J. Mol. Biol.*, 166:477–535 (1983)].

Nucleotides 2242–2568 contain a DNA sequence encoding the *E. coli* thioredoxin protein [Lim et al, *J. Bacteriol.*, 163:311–316 (1985)]. There is no translation termination codon at the end of the thioredoxin coding sequence in this plasmid.

Nucleotides 2569–2583 contain DNA sequence encoding the amino acid sequence for a short, hydrophilic, flexible spacer peptide "--GSGSG--". Nucleotides 2584–2598 provide DNA sequence encoding the amino acid sequence for the cleavage recognition site of enterokinase (EC 3.4.4.8), "--DDDDK--" [Maroux et al, *J. Biol. Chem.*, 246:5031–5039 (1971)].

Nucleotides 2599–3132 contain DNA sequence encoding the amino acid sequence of a modified form of mature human IL11 [Paul et al, *Proc. Natl. Acad. Sci. USA*, 87:7512–7516 (1990)], deleted for the N-terminal prolyl-residue normally found in the natural protein. The sequence includes a translation termination codon at the 3'-end of the IL11 sequence.

Nucleotides 3133–3159 provide a "Linker" DNA sequence containing restriction endonuclease sites. Nucleotides 3160–3232 provide a transcription termination sequence based on that of the *E. coli* aspA gene [Takagi et al, *Nucl. Acids Res.*, 13:2063–2074 (1985)]. Nucleotides 3233–3632 are DNA sequences derived from pUC-18.

This plasmid is modified in the following manner to replace the ribosome binding site of bacteriophage T7 with that of λCII. In the above-described plasmid, nucleotides 2222 and 2241 were removed by conventional means. Inserted in place of those nucleotides was a sequence of nucleotides formed by nucleotides 35566 to 35472 and 38137 to 38361 from bacteriophage lambda as described in Sanger et al (1982) cited above. This reference is incorporated by reference for the purpose of disclosing this sequence.

The DNA sequence encoding human IL11 in modified pALtrxA/EK/IL11ΔPro-581 (nucleotides 2599–3135) is replaced by the sequence shown in FIG. 3 [SEQ ID NO: 27 and 28].

The resulting plasmid was transformed into the *E. coli* host strain GI724 (F⁻, lacI$^q$, lacP$^{L8}$, ampC::λcI⁺) by the procedure of Dagert and Ehrlich, *Gene*, 6: 23 (1979). The untransformed host strain *E. coli* GI724 was deposited with the American Type Culture Collection, 12301 Parklawn Drive, Rockville, Md. on Jan. 31, 1991 under ATCC No. 55151 for patent purposes pursuant to applicable laws and regulations. Transformants were selected on 1.5% w/v agar plates containing IMC medium, which is composed of M9 medium [Miller, "Experiments in Molecular Genetics", Cold Spring Harbor Laboratory, New York (1972)] supplemented with 0.5% w/v glucose, 0.2% w/v casamino acids and 100 µg/ml ampicillin.

GI724 contains a copy of the wild-type λcI repressor gene stably integrated into the chromosome at the ampC locus, where it has been placed under the transcriptional control of *Salmonella typhimurium* trp promoter/operator sequences. In GI724, λcI protein is made only during growth in tryptophan-free media, such as minimal media or a minimal medium supplemented with casamino acids such as IMC, described above. Addition of tryptophan to a culture of GI724 will repress the trp promoter and turn off synthesis of λcI, gradually causing the induction of transcription from pL promoters if they are present in the cell.

GI724 transformed with the MSF containing plasmid was grown at 37° C. to an $A_{550}$ of 0.5 in IMC medium. Tryptophan was added to a final concentration of 100 µg/ml and the culture incubated for a further 4 hours.

All of the thioredoxin-MSF fusion protein was found in the soluble cellular fraction, representing up to 10% of the total protein. The fusion protein was heat stable, remaining soluble after treatment at 80 degrees Celsius for fifteen minutes. Preliminary testing with the fusion protein has shown activity in the fibrin clot assay described below.

EXAMPLE 6

Other Expression Systems

Manipulations can be performed for the construction of an insect vector for expression of MSF polypeptides in insect cells [See, e.g., procedures described in published European patent application 155,476].

Similarly yeast vectors may be constructed employing yeast regulatory sequences to express CDNA encoding the precursor, in yeast cells to yield secreted extracellular active MSF. Alternatively the polypeptide may be expressed intracellularly in yeast, the polypeptide isolated and refolded to yield active MSF. [See, e.g., procedures described in published PCT application WO 86/00639 and European patent application EP 123,289.]

EXAMPLE 7

Purification of MSF-K130 from COS Cells

An initial 3L batch of serum-free conditioned medium from COS-1 cells transfected with MSF-K130 yielded 140 ug of purified, active MSF protein using a three step purification process. COS-1 cell conditioned medium harvested under serum free conditions was concentrated on an Amicon YM10 membrane with a molecular weight cutoff of 10,000 daltons. The concentrate was centrifuged at 10,000 rpm in an SS34 rotor at 4° C. to remove cellular debris and precipitate. The supernatant was dialyzed against 20 mM sodium acetate pH 4.5 overnight at 4° C. The dialyzed protein solution was centrifuged again at low speed to remove residual precipitate.

The dialyzed MSF-K130 containing solution was applied to an S Toyopearl cation exchange FPLC column, equilibrated in 20 mM sodium acetate pH 4.5. Bound protein was eluted with a gradient of 0 to 1M NaCl in 20 mM sodium acetate, pH 4.5, at room temperature. Typically, MSF-K130 [SEQ ID NO: 77 and 78] eluted between 0.1 to 0.2 M NaCl. The active MSF peak was observed to have a molecular weight on SDS-PAGE 10–20% gradient polyacrylamide gels of between 20–50 kD under non-reducing conditions and 18–21 kD under reducing conditions. This was determined by probing a Western Immunoblot with rabbit antisera raised against a peptide in Exon III of the MSF gene of FIG. 1.

The pool of active MSF-K130 [SEQ ID NO: 77 and 78] was divided into three aliquots based on the molecular weights under non-reducing conditions. Pool A consisted of mostly high molecular weight dimer, 35–50 kD. Pool B consisted of intermediate molecular weight dimer species ranging from 20–45 kD; and pool C comprised predominantly monomer species of molecular weight range 14–25 kD. MSF from all three pools had a molecular weight of 18–21 kD under reducing conditions.

The final purification step was one cycle of reverse phase-HPLC. Protein from the three pools were acidified with 10% TFA to 0.1% TFA (v/v), filtered through a 0.45 um PVDF membrane and injected 1 ml/min onto a 25 cm×4.6 mm C4 (Vydec) reverse phase HPLC column equilibrated in 0.1% TFA at room temperature. Bound protein was eluted with a gradient of 0–95% acetonitrile in 0.1% TFA. Typically, MSF-K130 activity eluted between 15–30% buffer B (95% acetonitrile in 0.1% TFA).

EXAMPLE 8

Biological Activities of Human MSFs

The following assays were performed using the purified native urinary meg-CSF described in Example 1, and in some cases, crude or highly purified preparations of recombinant MSF-K130 [SEQ ID NO: 77 and 78]. The other recombinant or naturally occurring MSFs may exhibit MSF biological properties in these same assays or other assays.

A. Murine Fibrin Clot Assay

The meg-CSF obtained from Step 7 of the purification techniques of Example 1 was tested for activity in the megakaryocyte colony formation assay performed substantially as described in S. Kuriya et al, *Exp. Hematol.*, 15:896–901 (1987). A fibrin clot was formed containing $2.5 \times 10^5$ mouse bone marrow cells in a 6-well plate. The diluted sample was layered around the clot and incubated for 6 days. Thereafter, cells were fixed and megakaryocytes were stained for acetylcholinesterase, a specific marker for murine megakaryocytes. A colony was defined as three or more megakaryocytes per unit area.

A mixture of pure and mixed colonies containing megakaryocyte colonies were routinely observed: 70% pure megakaryocyte colonies containing no additional cell types: 30 % mixed megakaryocyte colonies containing additional non-megakaryocyte cell types to 50% pure: 50% mixed type depending on the assay. The pure colonies typically contain on average 4 to 5 cells per colony, ranging from 3 to 8 cells per colony. The cells within the colony are variable in size and appear to contain both mature and immature megakaryocytes. The megakaryocytes are fairly dispersed within the colony. A typical mixed megakaryocyte colony is composed on average of 10 cells per colony ranging from 7 to 17 cells. The cells appear more clustered than the megakaryocytes in pure megakaryocyte colonies.

The following control samples were included in every assay. A positive control was WEHI conditioned medium (murine IL-3), which produced between 7–25 (average 12) megakaryocyte colonies per clot, approximately 50% pure and 50% mixed megakaryocyte colonies. Another positive control was serum taken from lethally irradiated dogs at the nadir or low point of the platelet count [see Mazur et al, *Exp. Hematol.*, 13:1164–1172 (1985)], which produced between 6–22 (average 15) megakaryocyte colonies per clot, of which approximately 70% were pure and 30% were mixed megakaryocyte colonies. The negative control was Iscoves Medium, which produced 2–4 megakaryocyte colonies per clot.

In the assay, the purified urinary meg-CSF has a specific activity of greater than approximately $5 \times 10^7$ dilution units/mg of protein. A unit of activity is defined as described in Example 1.

The major meg-CSF obtained from bone marrow transplant urine eluted from the S-Toyopearl cation exchange column chromatography step in the purification of Example 1 has been analyzed in this assay alone, together, and in combination with other cytokines. In the fibrin clot assay, it produced between 6–16 (average 13) megakaryocyte colonies, with 50–70% pure megakaryocyte colonies. The urinary meg-CSF has been shown to have variable synergy with murine IL-3 and does not synergize with human IL-6 or murine IL-4 in the fibrin clot culture system.

Megakaryocyte colony formation was observed in response to recombinant MSF-K130 [SEQ ID NO: 77 and 78] in the murine bone marrow fibrin clot assay. Murine megakaryocytes were identified as acetylcholinesterase positive cells and a megakaryocyte colony was defined as greater than three megakaryocyte cells per unit area in a fibrin clot culture. Recombinant MSF typically stimulated megakaryocyte colonies of three to six cells/unit area and averaged between 6 to 15 colonies/$2.5 \times 10^5$ murine bone marrow cells.

Two types of megakaryocyte colonies were observed in the assay, pure megakaryocyte colonies and megakaryocyte cells with other cell types, termed mixed megakaryocyte colonies. In one fibrin clot, the two colony types were at a ratio between 1:1 to 7:3 pure colonies to mixed megakaryocyte colonies. This ratio was consistent throughout the purification of recombinant MSF-K130 [SEQ ID NO: 77 and 78]. The number of megakaryocyte cells/colony and size of megakaryocytes were about the same for both pure and mixed colonies, some megakaryocytes were smaller in the mixed megakaryocyte colonies.

An increase in bioactivity was usually observed from active MSF fractions obtained from the C4 RP-HPLC column. All three pools from the S Toyopearl cation exchange column gave rise to bioactive MSF protein on RP-HPLC. The final specific activity of MSF after the RP-HPLC step was greater than $1 \times 10^7$ units/mg in all three pools. The active peaks were also positive on the MSF Western Blot.

When RP-HPLC-purified MSF-K130 [SEQ ID NO: 77 and 78] from the A pool was subjected to SDS-PAGE under non-reducing conditions, bioactive protein was extracted from gel slices corresponding to 35–50 kD molecular weight species. A silver stain gel and Western immunoblot data showed that 95% of the 35–50 kD recombinant MSF protein reduced to 18–21 kD and 5% did not shift upon reduction on a 10–20% acrylamide gradient SDS-PAGE.

The supernatant from COS-1 cells transfected with MSF-K130 cDNA [SEQ ID NO: 77] was variably active on the fibrin clot assay. In each assay the samples were tested in duplicate and in three dilutions.

B. Human Plasma Clot Megakaryocyte Colony Formation

The human urinary meg-CSF of this invention was also tested for human activity on the plasma clot MSF assay described in E. Mazur et al, *Blood*, 57:277–286 (1981) with modifications. Non-adherent peripheral blood cells were isolated from Leukopacs and frozen in aliquots. The test sample was mixed with platelet-poor human AB plasma and $1.25 \times 10^5$ cells in 24-well plates and allowed to clot by the addition of calcium. After a 12 day incubation, megakaryocytes were identified using a monoclonal antibody directed against platelet glycoproteins IIb/IIIa and a horseradish peroxidase/anti-peroxidase chromogenic detection system. Recombinant human IL-3 [Genetics Institute, Inc.] was used as a positive control, producing 12–30 megakaryocyte colonies per clot with approximately 60% pure and 40% mixed megakaryocyte colonies. As in the murine assay, the aplastic dog serum was also used as a positive control, which produced between 5–10 megakaryocyte colonies per clot, of which approximately 50% were pure megakaryocyte colonies containing less than 10 cells, and 50% were mixed megakaryocyte colonies containing more than 40 megakaryocytes. The negative control was Alpha Medium, which produced 0–1 megakaryocyte colonies per clot.

The human urinary meg-CSF product from Step 6 of the purification scheme of Example 1 had variable activity in this assay. MSF-K130 [SEQ ID NO: 77 and 78] has shown variable activity in the human plasma clot megakaryocyte colony assay.

C. Synergistic Effects

Recombinant MSF-K130 Cos-1 cell supernatant and purified recombinant MSF were assayed alone and in combination with other cytokines in the various CFU-MEG assay systems, fibrin clot, agar and the human CFU-MEG plasma clot assays.

Variable synergy with IL-3 was observed in the murine bone marrow fibrin clot assay. The stimulation of megakaryocyte colonies increased above either protein alone when both murine IL-3 and MSF-K130 were cultured with bone marrow cells progenitors in the fibrin clot assay. A suboptimal level of murine IL-3 (15 units/ml) and an optimal level of MSF-K130 each stimulate an average of 6–15 CFU-meg/$2.5 \times 10^5$ murine bone marrow cells in the fibrin clot assay. In combination, increased megakaryocyte colony stimulation of over 35 megakaryocyte colonies have been observed. The ratio of pure megakaryocyte colonies to mixed megakaryocyte colonies and the size of the megakaryocyte colonies were the same for the combination cultures as for the individual MSF cultures.

D. *E. Coli* Expressed MSF Activity

MSF expressed in *Escherichia coli* as a thioredoxin-MSF-K130 fusion protein was soluble and active in the fibrin clot assay. *E. coli* expressed MSF-K130 stimulated the same range of CFU-meg/$2.5 \times 10^5$ murine bone marrow cells as COS derived MSF-K130. This activity was not neutralized by the addition of anti-IL-3 antibody at a level that did neutralize CFU-Meg formation by IL-3. Megakaryocyte colony formation activity of the MSF-K13O thioredoxin fusion protein from *E. coli* lysate was $5 \times 10^6$ dilution units/ml. The specific activity of the MSF-K130 thioredoxin fusion protein in *E. coli* lysate was greater than $1 \times 10^6$ U/mg. Thioredoxin was not active in the assay.

EXAMPLE 9

Construction of CHO Cell Lines Expressing High Levels of MSF

One method for producing high levels of the MSF protein of the invention from mammalian cells involves the construction of cells containing multiple copies of the cDNA encoding the MSF.

The cDNA is co-transfected with an amplifiable marker, e.g., the DHFR gene for which cells containing increasing concentrations of methotrexate (MTX) according to the procedures of Kaufman and Sharp, *J. Mol. Biol.,* (1982) supra. This approach can be employed with a number of different cell types. Alternatively, the MSF cDNA and drug resistance selection gene (e.g., DHFR) may be introduced into the same vector. One desirable vector for this approach is pED4DPC-1. MSF-K130 [SEQ ID NO: 77 and 78] and MSF-N141 [SEQ ID NO: 79 and 80] are being expressed in vector pEMC3–1, a vector identical to pE04DPC-1, but in which the polylinker has been changed (PstI, NotI, SalI, SnaBI, EcoRI, PacI) as described above per pMT21.

For example, the pMT21 vector containing the MSF gene in operative association with other plasmid sequences enabling expression thereof is introduced into DHFR-deficient CHO cells, DUKX-BII, along with a DHFR expression plasmid such as pAdD26SVpA3 [Kaufman, *Proc. Natl. Acad. Sci. USA,* 82:689–693 (1985)] by calcium phosphate coprecipitation and transfection. Alternatively, the pED4DPC-1 vector containing the MSF gene in operative association with other plasmid sequences enabling expression thereof is introduced into DHFR-deficient CHO cells, DUKX-BII, by protoplast fusion or transfection. The MSF gene and DHFR marker gene are both efficiently expressed when MSF is introduced into pEMC2B1.

DHFR expressing transformants are selected for growth in alpha media with dialyzed fetal calf serum. Transformants are checked for expression of MSF by Western blotting, bioassay, or RNA blotting and positive pools are subsequently selected for amplification by growth in increasing concentrations of MTX (sequential steps in 0.02, 0.2, 1.0 and 5 uM MTX) as described in Kaufman et al., *Mol. Cell Biol.,* 5:1750 (1983). The amplified lines are cloned, and MSF protein expression is monitored by the fibrin clot assay. MSF expression is expected to increase with increasing levels of MTX resistance.

In any of the expression systems described above, the resulting cell lines can be further amplified by appropriate drug selection, resulting cell lines recloned and the level of expression assessed using the murine fibrin clot assay described in Example 4.

The MSF expressing CHO cell lines can be adapted to growth in serum-free medium. MSF expressed in CHO cells is purified from serum-free conditioned medium using the same purification scheme as COS-1 cell supernatant. Homogeneous MSF can be isolated from conditioned medium from the cell line using methods familiar in the art, including techniques such as lectin-affinity chromatography, reverse phase HPLC, FPLC and the like.

The foregoing descriptions detail presently preferred embodiments of the invention. Numerous modifications and variations in practice of this invention are expected to occur to those skilled in the art. Such modifications and variations are encompassed within the following claims.

SEQUENCE LISTING (143 sequences)

SEQ ID NO: 1 - DNA (cDNA), 5008 bp; double-stranded, unknown
  CDS 1..4212
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaaaaaaaaaaaaaaaa

SEQ ID NO: 2 - protein, 1404 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 3 - DNA (cDNA), 76 bp; double-stranded, unknown
  CDS 1..75
atggcatggaaaacacttcccatttacctgttgttgctgctgtctgttttcgtgattcagcaagtttcatctcaag

SEQ ID NO: 4 - protein, 25 aa
MAWKTLPIYLLLLLSVFVIQQVSSQ

SEQ ID NO: 5 - DNA (cDNA), 124 bp; double-stranded, unknown
  CDS 1..123
gatttatcaagctgtgcagggagatgtggggaagggtattctagagatgccacctgcaactgtgattataactgtcaacactacatggagtgctgccctgatttcaagagagtctgcactgcgg

SEQ ID NO: 6 - protein, 41 aa
DLSSCAGRCGEGYSRDATCNCDYNCQHYMECCPDFKRVCTA

SEQ ID NO: 7 - DNA (cDNA), 121 bp; double-stranded, unknown
  CDS 1..120
gagctttcctgtaaaggccgctgctttgagtccttcgagagagggagggagtgtgactgcgacgcccaatgtaagaagtatgacaagtgctgtcccgattatgagagtttctgtgcagaag

SEQ ID NO: 8 - protein, 40 aa
ELSCKGRCFESFERGRECDCDAQCKKYDKCCPDYESFCAE

SEQ ID NO: 9 - DNA (cDNA), 151 bp; double-stranded, unknown
  CDS 1..150
gtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaag

SEQ ID NO: 10 - protein, 50 aa
VHNPTSPPSSKKAPPPSGASQTIKSTTKRSPKPPNKKKTKKVIESEEITE

SEQ ID NO: 11 - DNA (cDNA), 130 bp; double-stranded, unknown
  CDS 1..129
gaacattctgtttctgaaaatcaagagtcctcctcctcctcctcctcttcctcttcttcttcaacaatttggaaaatcaagtcttccaaaaattcagctgctaatagagaattacagaagaaactcaaag

SEQ ID NO: 12 - protein, 43 aa
EHSVSENQESSSSSSSSSSSSTIWKIKSSKNSAANRELQKKLK

SEQ ID NO: 13 - DNA (cDNA), 2824 bp; double-stranded, unknown
  CDS 1..2823
gtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccg

SEQ ID NO: 14 - protein, 941 aa
VKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLS

SEQ ID NO: 15 - DNA (cDNA), 79 bp; double-stranded, unknown
  CDS 1..78
gatgagaccaatatatgcaatggtaagccagtagatggactgactactttgcgcaatgggacattagttgcattccgag

SEQ ID NO: 16 - protein, 26 aa
DETNICNGKPVDGLTTLRNGTLVAFR

SEQ ID NO: 17 - DNA (cDNA), 138 bp; double-stranded, unknown
  CDS 1..138
ggtcattatttctggatgctaagtccattcagtccaccatctccagctcgcagaattactgaagtttggggtattccttcccccattgatactgtttttactaggtgcaactgtgaaggaaaaactttcttctttaag

SEQ ID NO: 18 - protein, 46 aa
GHYFWMLSPFSPPSPARRITEVWGIPSPIDTVFTRCNCEGKTFFFK

SEQ ID NO: 19 - DNA (cDNA), 160 bp; double-stranded, unknown
  CDS 1..159
gattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtg

SEQ ID NO: 20 - protein, 53 aa
DSQYWRFTNDIKDAGYPKPIFKGFGGLTGQIVAALSTAKYKNWPESVYFFKRG

SEQ ID NO: 21 - DNA (cDNA), 196 bp; double-stranded, unknown
  CDS 1..195
ggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaag

SEQ ID NO: 22 - protein, 65 aa
GSIQQYIYKQEPVQKCPGRRPALNYPVYGEMTQVRRRRFERAIGPSQTHTIRIQYSPARLAYQDK

SEQ ID NO: 23 - DNA (cDNA), 127 bp; double-stranded, unknown
  CDS 1..126
ggtgtccttcataatgaagttaaagtgagtatactgtggagaggacttccaaatgtggttacctcagctatatcactgcccaacatcagaaaacctgacggctatgattactatgccttttctaaag

SEQ ID NO: 24 - protein, 42 aa
GVLHNEVKVSILWRGLPNVVTSAISLPNIRKPDGYDYYAFSK

SEQ ID NO: 25 - DNA (cDNA), 99 bp; double-stranded, unknown
  CDS 1..96
gatcaatactataacattgatgtgcctagtagaacagcaagagcaattactactcgttctgggcagaccttatccaaagtctggtacaactgtccttag

SEQ ID NO: 26 - protein, 32 aa
DQYYNIDVPSRTARAITTRSGQTLSKVWYNCP

SEQ ID NO: 27 - DNA (cDNA), 611 bp; double-stranded, unknown
  CDS 1..333
gatgacgatgacaagaacggtttatcttcttgtgcaggtcgttgtggtgaaggttattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaataacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagattagctcgag

SEQ ID NO: 28 - protein, 111 aa
DDDDKNGLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIK

SEQ ID NO: 29 - DNA (cDNA), 696 bp; double-stranded, unknown
  CDS 1..693
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagatcaatactataacattgatgtgcctagtagaacagcaagagcaattactactcgttctgggcagaccttatccaaagtctggtacaactgtccttag

SEQ ID NO: 30 - protein, 231 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKDQYYNIDVPSRTARAITTRSGQTLSKVWYNCP

SEQ ID NO: 31 - DNA (cDNA), 567 bp; double-stranded, unknown
  CDS 1..564
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagatcaatactataacattgatgtgcctagtagaacagcaagagcaattactactcgttctgggcagaccttatccaaagtctggtacaactgtccttag

SEQ ID NO: 32 - protein, 188 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEDQYYNIDVPSRTARAITTRSGQTLSKVWYNCP

SEQ ID NO: 33 - DNA (cDNA), 417 bp; double-stranded, unknown
  CDS 1..414
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagatcaatactataacattgatgtgcctagtagaacagcaagagcaattactactcgttctgggcagaccttatccaaagtctggtacaactgtccttag

SEQ ID NO: 34 - protein, 138 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEDQYYNIDVPSRTARAITTRSGQTLSKVWYNCP

SEQ ID NO: 35 - DNA (cDNA), 294 bp; double-stranded, unknown
  CDS 1..291
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagatcaatactataacattgatgtgcctagtagaacagcaagagcaattactactcgttctgggcagaccttatccaaagtctggtacaactgtccttag

SEQ ID NO: 36 - protein, 97 aa
MAWKTLPIYLLLLLSVFVIQQVSSQELSCKGRCFESFERGRECDCDAQCKKYDKCCPDYESFCAEDQYYNIDVPSRTARAITTRSGQTLSKVWYNCP

SEQ ID NO: 37 - DNA (cDNA), 444 bp; double-stranded, unknown
  CDS 1..441
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagatcaatactataacattgatgtgcctagtagaacagcaagagcaattactactcgttctgggcagaccttatccaaagtctggtacaactgtccttag

SEQ ID NO: 38 - protein, 147 aa
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITEDQYYNIDVPSRTARAITTRSGQTLSKVWYNCP

SEQ ID NO: 39 - DNA (cDNA), 4086 bp; double-stranded, unknown
  CDS 1..4083
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 40 - protein, 1361 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 41 - DNA (cDNA), 3936 bp; double-stranded, unknown
  CDS 1..3933
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 42 - protein, 1311 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 43 - DNA (cDNA), 3813 bp; double-stranded, unknown
  CDS 1..3810
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 44 - protein, 1270 aa
MAWKTLPIYLLLLLSVFVIQQVSSQELSCKGRCFESFERGRECDCDAQCKKYDKCCPDYESFCAEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 45 - DNA (cDNA), 3963 bp; double-stranded, unknown
  CDS 1..3960
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 46 - protein, 1320 aa
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 47 - DNA (cDNA), 4065 bp; double-stranded, unknown
  CDS 1..4062
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 48 - protein, 1354 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 49 - DNA (cDNA), 3945 bp; double-stranded, unknown
  CDS 1..3942
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 50 - protein, 1314 aa
MAWKTLPIYLLLLLSVFVIQQVSSQDLSSCAGRCGEGYSRDATCNCDYNCQHYMECCPDFKRVCTAEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 51 - DNA (cDNA), 4092 bp; double-stranded, unknown
  CDS 1..4089
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 52 - protein, 1363 aa
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 53 - DNA (cDNA), 1392 bp; double-stranded, unknown
  CDS 1..1389
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 54 - protein, 463 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 55 - DNA (cDNA), 319 bp; double-stranded, unknown
  CDS 1..318
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaag

SEQ ID NO: 56 - protein, 106 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAE

SEQ ID NO: 57 - DNA (cDNA), 3148 bp; double-stranded, unknown
  CDS 1..3147
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccg

SEQ ID NO: 58 - protein, 1049 aa
MAWKTLPIYLLLLLSVFVIQQVSSQELSCKGRCFESFERGRECDCDAQCKKYDKCCPDYESFCAEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLS

SEQ ID NO: 59 - DNA (cDNA), 3963 bp; double-stranded, unknown; identical to SEQ ID NO: 45
  CDS 1..3960

SEQ ID NO: 60 - protein, 1320 aa; identical to SEQ ID NO: 46

SEQ ID NO: 61 - DNA (cDNA), 4215 bp; double-stranded, unknown
  CDS 1..4212
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 62 - protein, 1404 aa; identical to SEQ ID NO: 2

SEQ ID NO: 63 - DNA (cDNA), 1119 bp; double-stranded, unknown
  CDS 1..1116
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagaacattctgtttctgaaaatcaagagtcctcctcctcctcctcctcttcctcttcttcttcaacaatttggaaaatcaagtcttccaaaaattcagctgctaatagagaattacagaagaaactcaaagatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 64 - protein, 372 aa
MAWKTLPIYLLLLLSVFVIQQVSSQELSCKGRCFESFERGRECDCDAQCKKYDKCCPDYESFCAEEHSVSENQESSSSSSSSSSSSTIWKIKSSKNSAANRELQKKLKDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 65 - DNA (cDNA), 1272 bp; double-stranded, unknown
  CDS 1..1269
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 66 - protein, 423 aa
MAWKTLPIYLLLLLSVFVIQQVSSQDLSSCAGRCGEGYSRDATCNCDYNCQHYMECCPDFKRVCTAVHNPTSPPSSKKAPPPSGASQTIKSTTKRSPKPPNKKKTKKVIESEEITEEHSVSENQESSSSSSSSSSSSTIWKIKSSKNSAANRELQKKLKDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 67 - DNA (cDNA), 1269 bp; double-stranded, unknown
  CDS 1..1266
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 68 - protein, 422 aa
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 69 - DNA (cDNA), 891 bp; double-stranded, unknown
  CDS 1..888
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaaggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaagatcaatactataacattgatgtgcctagtagaacagcaagagcaattactactcgttctgggcagaccttatccaaagtctggtacaactgtccttag

SEQ ID NO: 70 - protein, 296 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKGSIQQYIYKQEPVQKCPGRRPALNYPVYGEMTQVRRRRFERAIGPSQTHTIRIQYSPARLAYQDKDQYYNIDVPSRTARAITTRSGQTLSKVWYNCP

SEQ ID NO: 71 - DNA (cDNA), 714 bp; double-stranded, unknown
  CDS 1..711
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtgatcaatactataacattgatgtgcctagtagaacagcaagagcaattactactcgttctgggcagaccttatccaaagtctggtacaactgtccttag

SEQ ID NO: 72 - protein, 237 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGDQYYNIDVPSRTARAITTRSGQTLSKVWYNCP

SEQ ID NO: 73 - DNA (cDNA), 3117 bp; double-stranded, unknown
  CDS 1..3114
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatcaatactataacattgatgtgcctagtagaacagcaagagcaattactactcgttctgggcagaccttatccaaagtctggtacaactgtccttag

SEQ ID NO: 74 - protein, 1038 aa
MAWKTLPIYLLLLLSVFVIQQVSSQELSCKGRCFESFERGRECDCDAQCKKYDKCCPDYESFCAEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDQYYNIDVPSRTARAITTRSGQTLSKVWYNCP

SEQ ID NO: 75 - DNA (cDNA), 654 bp; double-stranded, unknown
  CDS 1..651
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagatgagaccaatatatgcaatggtaagccagtagatggactgactactttgcgcaatgggacattagttgcattccgagatcaatactataacattgatgtgcctagtagaacagcaagagcaattactactcgttctgggcagaccttatccaaagtctggtacaactgtccttag

SEQ ID NO: 76 - protein, 217 aa
MAWKTLPIYLLLLLSVFVIQQVSSQDLSSCAGRCGEGYSRDATCNCDYNCQHYMECCPDFKRVCTAVHNPTSPPSSKKAPPPSGASQTIKSTTKRSPKPPNKKKTKKVIESEEITEEHSVSENQESSSSSSSSSSSSTIWKIKSSKNSAANRELQKKLKDETNICNGKPVDGLTTLRNGTLVAFRDQYYNIDVPSRTARAITTRSGQTLSKVWYNCP

SEQ ID NO: 77 - DNA (cDNA), 393 bp; double-stranded, unknown
  CDS 1..390
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaataa

SEQ ID NO: 78 - protein, 130 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIK

SEQ ID NO: 79 - DNA (cDNA), 423 bp; double-stranded, unknown
  CDS 1..423
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaac

SEQ ID NO: 80 - protein, 141 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPN

SEQ ID NO: 81 - DNA (cDNA), 393 bp; double-stranded, unknown
  CDS 1..393
gatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaa

SEQ ID NO: 82 - protein, 131 aa
DLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITE

SEQ ID NO: 83 - DNA (cDNA), 3066 bp; double-stranded, unknown
  CDS 1..3066
gatttatcaagctgtgcagggagatgtggggaagggtattctagagatgccacctgcaactgtgattataactgtcaacactacatggagtgctgccctgatttcaagagagtctgcgagctttcctgtaaaggccgctgctttgagtccttcgagagagggagggagtgtgactgcgacgcccaatgtaagaagtatgacaagtgctgtcccgattatgagagtttctgtgcagaaactgcggtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttcc

SEQ ID NO: 84 - protein, 1022 aa
DLSSCAGRCGEGYSRDATCNCDYNCQHYMECCPDFKRVCELSCKGRCFESFERGRECDCDAQCKKYDKCCPDYESFCAETAVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLS

SEQ ID NO: 85 - DNA (cDNA), 390 bp; double-stranded, unknown
  CDS 1..390
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaa

SEQ ID NO: 86 - protein, 130 aa; identical to SEQ ID NO: 78

SEQ ID NO: 87 - DNA (cDNA), 516 bp; double-stranded, unknown
  CDS 1..516
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctct

SEQ ID NO: 88 - protein, 172 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSS

SEQ ID NO: 89 - DNA (cDNA), 576 bp; double-stranded, unknown
  CDS 1..576
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaataga

SEQ ID NO: 90 - protein, 192 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANR

SEQ ID NO: 91 - DNA (cDNA), 612 bp; double-stranded, unknown
  CDS 1..612
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaag

SEQ ID NO: 92 - protein, 204 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNK

SEQ ID NO: 93 - DNA (cDNA), 627 bp; double-stranded, unknown
  CDS 1..627
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaa

SEQ ID NO: 94 - protein, 209 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTK

SEQ ID NO: 95 - DNA (cDNA), 660 bp; double-stranded, unknown
  CDS 1..660
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagat

SEQ ID NO: 96 - protein, 220 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTKKKPTPKPPVVD

SEQ ID NO: 97 - DNA (cDNA), 348 bp; double-stranded, unknown
  CDS 1..348
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctccc

SEQ ID NO: 98 - protein, 116 aa
MAWKTLPIYLLLLLSVFVIQQVSSQELSCKGRCFESFERGRECDCDAQCKKYDKCCPDYESFCAEVKDNKKNRTKKKPTPKPPVVDEAGSGLDNGDFKVTTPDTSTTQHNKVSTSP

SEQ ID NO: 99 - DNA (cDNA), 153 bp; double-stranded, unknown
  CDS 1..153
gtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctccc

SEQ ID NO: 100 - protein, 51 aa
VKDNKKNRTKKKPTPKPPVVDEAGSGLDNGDFKVTTPDTSTTQHNKVSTSP

SEQ ID NO: 101 - DNA (cDNA), 471 bp; double-stranded, unknown
  CDS 1..471
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctccc

SEQ ID NO: 102 - protein, 157 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVKDNKKNRTKKKPTPKPPVVDEAGSGLDNGDFKVTTPDTSTTQHNKVSTSP

SEQ ID NO: 103 - DNA (cDNA), 3420 bp; double-stranded, unknown
  CDS 1..3420
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttcc

SEQ ID NO: 104 - protein, 1140 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLS

SEQ ID NO: 105 - DNA (cDNA), 468 bp; double-stranded, unknown
  CDS 1..468
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaa

SEQ ID NO: 106 - protein, 156 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITE

SEQ ID NO: 107 - DNA (cDNA), 345 bp; double-stranded, unknown
  CDS 1..345
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaa

SEQ ID NO: 108 - protein, 115 aa
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITE

SEQ ID NO: 109 - DNA (cDNA), 348 bp; double-stranded, unknown; identical to SEQ ID NO: 97
  CDS 1..348

SEQ ID NO: 110 - protein, 116 aa; identical to SEQ ID NO: 98

SEQ ID NO: 111 - DNA (cDNA), 153 bp; double-stranded, unknown; identical to SEQ ID NO: 99
  CDS 1..153

SEQ ID NO: 112 - protein, 51 aa; identical to SEQ ID NO: 100

SEQ ID NO: 113 - DNA (cDNA), 471 bp; double-stranded, unknown; identical to SEQ ID NO: 101
  CDS 1..471

SEQ ID NO: 114 - protein, 157 aa; identical to SEQ ID NO: 102

SEQ ID NO: 115 - DNA (cDNA), 621 bp; double-stranded, unknown
  CDS 1..621
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctccc

SEQ ID NO: 116 - protein, 207 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEVKDNKKNRTKKKPTPKPPVVDEAGSGLDNGDFKVTTPDTSTTQHNKVSTSP

SEQ ID NO: 117 - DNA (cDNA), 469 bp; double-stranded, unknown
  CDS 1..468
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaag

SEQ ID NO: 118 - protein, 156 aa; identical to SEQ ID NO: 106

SEQ ID NO: 119 - DNA (cDNA), 348 bp; double-stranded, unknown; identical to SEQ ID NO: 97
  CDS 1..348

SEQ ID NO: 120 - protein, 116 aa; identical to SEQ ID NO: 98

SEQ ID NO: 121 - DNA (cDNA), 346 bp; double-stranded, unknown
  CDS 1..345
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaag

SEQ ID NO: 122 - protein, 115 aa; identical to SEQ ID NO: 108

SEQ ID NO: 123 - DNA (genomic), 24 bp; single-stranded, unknown
tgcaggcgagcctgaattcctcga

SEQ ID NO: 124 - DNA (genomic), 20 bp; single-stranded, unknown
cgcgcggccgcgactattcg

SEQ ID NO: 125 - DNA (genomic), 24 bp; single-stranded, unknown
gcgctcgagctaagaggaggagga

SEQ ID NO: 126 - DNA (genomic), 24 bp; single-stranded, unknown
gcgctcgagctatctattagcagc

SEQ ID NO: 127 - DNA (genomic), 24 bp; single-stranded, unknown
gcgctcgagctacttgttatcttt

SEQ ID NO: 128 - DNA (genomic), 24 bp; single-stranded, unknown
gcgctcgagctaatctacaactgg

SEQ ID NO: 129 - DNA (genomic), 24 bp; single-stranded, unknown
gcgctcgagctagtttggtggttt

SEQ ID NO: 130 - DNA (genomic), 24 bp; single-stranded, unknown
gcgctcgagctaagttctgttctt

SEQ ID NO: 131 - DNA (cDNA), 624 bp; double-stranded, unknown
  CDS 1..624
atggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaact

SEQ ID NO: 132 - protein, 208 aa
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRT

SEQ ID NO: 133 - DNA (genomic), 24 bp; single-stranded, unknown
  anti-sense: YES
tttggtagtttaatcgagctcgcg

SEQ ID NO: 134 - DNA (genomic), 68 bp; single-stranded, unknown
cgaggttaaaaaacgtctaggccccccgaaccacggggacgtggttttcctttgaaaaacacgattgc

SEQ ID NO: 135 - DNA (cDNA), 621 bp; double-stranded, unknown; identical to SEQ ID NO: 115
  CDS 1..621

SEQ ID NO: 136 - protein, 207 aa; identical to SEQ ID NO: 116

SEQ ID NO: 137 - DNA (cDNA), 348 bp; double-stranded, unknown; identical to SEQ ID NO: 97
  CDS 1..348

SEQ ID NO: 138 - protein, 116 aa; identical to SEQ ID NO: 98

SEQ ID NO: 139 - DNA (cDNA), 396 bp; double-stranded, unknown
  CDS 1..396
gatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctccc

SEQ ID NO: 140 - protein, 132 aa
DLSSCAGRCGEGYSRDATCNCDYNCQHYMECCPDFKRVCTAELSCKGRCFESFERGRECDCDAQCKKYDKCCPDYESFCAEVKDNKKNRTKKKPTPKPPVVDEAGSGLDNGDFKVTTPDTSTTQHNKVSTSP

SEQ ID NO: 141 - DNA (cDNA), 3942 bp; double-stranded, unknown
  CDS 1..3939
atggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttag

SEQ ID NO: 142 - protein, 1313 aa
MAWKTLPIYLLLLLSVFVIQQVSSQELSCKGRCFESFERGRECDCDAQCKKYDKCCPDYESFCAEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGEMTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 143 - protein, 5 aa
DDDDK

What is claimed is:

1. Isolated megakaryocyte stimulating factor comprising an amino acid sequence as set forth in SEQ ID NO:78.

2. The megakaryocyte stimulating factor according to claim 1, produced by the steps of
   (a) culturing a cell transformed with a DNA sequence encoding expression of said megakaryocyte stimulating factor; and
   (b) recovering, isolating and purifying from said culture medium a protein encoded by the DNA sequence recited in step (a).

3. A pharmaceutical composition comprising a therapeutically effective amount of megakaryocyte stimulating factor or a fragment thereof in a pharmaceutically effective vehicle.

* * * * *

UNITED STATES PATENT AND TRADEMARK OFFICE
CERTIFICATE OF CORRECTION

PATENT NO.    : 6,433,142 B1
DATED         : August 13, 2002
INVENTOR(S)   : Katherine Turner et al.

It is certified that error appears in the above-identified patent and that said Letters Patent is hereby corrected as shown below:

Column 38,
Lines 17-20, replace claim 3, which, as issued, reads: "3. A pharmaceutical composition comprising a therapeutically effective amount of megakaryocyte stimulating factor or a fragment thereof in a pharmaceutically effective vehicle" with:

-- 3. A composition comprising megakaryocyte stimulating factor according to claim 1 in a pharmaceutically effective vehicle. --

Signed and Sealed this

Eleventh Day of March, 2003

JAMES E. ROGAN
*Director of the United States Patent and Trademark Office*